United States Patent 12,569,549 (FLAVIVIRUS VACCINE) - sequence listing, part 13

SEQ ID NO: 7078 - RNA, 9876 nt, synthetic construct
  misc_feature 1..9876: note = derived and/or modified CDS sequence (wt) from DENV-2__JN851123__SS-prME
  source 1..9876: mol_type = other RNA
actgcaggtataattattatgatgattccaacagtgatggcgttccatttaaccacacgcaacggagaaccacacatgatcgtcagtagacaagagaaagggaaaagtcttctgttcaaaacagagaacggtgtgaacatgtgtaccctcatggccatggaccttggtgaactgtgtgaagacacaatcacttataattgtcctcttctcaagcagaatgaaccagaagacatagactgttggtgcaactctacgtctacatgggtaacttatgggacatgcaccgccacaggagaacacagaagggaaaaaagatcagtagcactcgttccacatgtgggaatgggactggagacacgaactgagacatggatgtcatcagaaggggcctggaaacatgcacagagaattgaaacttgggtcttgagacatccaggcttcaccataatggcagctatcctggcatacaccataggaacaacatatttccaaagagtcctgattttcatcttactgacagctgtcgctccttcaatgacaatgcgttgtataggaatatcaaatagagactttgtggaaggggtttcaggaggaagctgggttgatatagtcttggaacatggaagctgtgtgacgacaatggcgaaaaataaaccaacattggattttgaactgataaaaacagaagccaaacatcccgccactctaaggaagtattgtattgaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaattgtgcaaccagaaaacttggagtacaccattgtgataacacctcactcaggggaagagaatgcagttggaaatgacacaggaaaacacggcaaggaaattaaagtaacaccacagagttccattacagaagcagaactaacaggctatggcactgtcacgatggaatgctctccgagaacgggcctcgacttcaatgagatggtgttgctgcagatggaaaacaaggcttggctggtgcacaggcaatggttcttagacctgccattaccatggctgcccggagcagacacacaaggatcaaattggatacagaaggagacattggtcactttcaaaaatccccatgcaaagaaacaagatgttgttgttttaggatcccaagaaggggctatgcacacagcactcacaggggccacggaaatccagatgtcatcaggaaacttactgttcacaggacatcttaaatgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaattgtcacagaaaaggacagcccagtcaacatagaagcagaacctccattcggagacagctacatcattataggagtagagccgggacaactgaagcttagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgctttcagtggagtttcatggactatgaaaatcctcataggagtcgtcatcacatggataggaatgaattcacgcagcacctcactgtctgtgtcactagtattagtgggagtcgtgacattgtatttgggggttatggtgcaggccgatagtggttgcgttgtgagttggaaaaacaaagaactgaaatgtggcagtgggatttttattacagacaacgtgcacacatggacagaacaatacaaattccaaccagaatccccttcaaagctggcttcagctatccagaaggctcatgaagagggcatttgtggaatccgctcagtaacaagactggagaatctgatgtggaaacaaataacaccagaactgaatcacattctatcagaaaatgagataaagttgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaatacaaacagagcttggaactcactagaagttgaagactatggttttggagtattcaccaccaacatatggctgaaattgaaagaaaggcaggatgtattttgtgactcaaaactcatgtcagcagccataaaagacaacagagccgtccacgccgatatgggttattggatagaaagcgcactcaatgacacatggaagattgagaaagcctcttttattgaagttaaaagctgccactggccaaagtcacatactctctggagcaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaaccacagtggtggtgactgaggattgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtctctttcgtgacattgatcacagggaacatgtcttttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaatcgtactcctctctcagagcaccataccagagactatacttgaactgactgacgcgttggctttggggatgatggttctcaaaatagtaagaaacatggaaaagtatcaactagcagtgactatcatggctatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccattaaatgaggctattatggcagtcgggatggtgagcattttagccagttctctcttaaagaatgatattcccatgacaggaccattagtggctggagggcttctcactgtgtgttacgtgcttactggaagatcggctgatttggaactggagagagctgctgacgtaagatgggaagaacaggcagagatatcaggaagcagtccaattctgtcgataacaatatcggaagatggtagcatgtcgataaaaaatgaagaagaagaacaaacactgaccatactcattagaacaggactgctggtgatatcaggactttttcccgtgtcaataccaatcacggcagctgcatggtacctgtgggaggtgaaaaaacaacgagccggagtattgtgggatgtcccttcacctccacctgtgggaaaggccgaactggaagatggagcctatagaatcaagcagaaagggattctagggtactcgcagatcggagccggagtttacaaagaaggaacattccacacaatgtggcatgtcacacgtggtgctgttctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggcgccgtatctctggacttttctcccggaacgtcaggatctccaatcgtcgacaaaaaaggaaaagttgtgggcctttatggcaacggtgtcgtcacaaggagtggaacatatgtaagtgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaattctagcccccactagagttgtggcggccgaaatggaagaagctctcagaggacttccaataagataccaaaccccagctatcagagctgagcacactggacgggagattgtggatctaatgtgtcacgccacatttaccatgaggctactatcaccaattagagtgccaaattacaacctgattatcatggatgaagcccattttacagacccagcaagcatagcagctagaggatacatttcaactcgagtagagatgggtgaagcagctgggattttcatgacagctacccctcctggaagcagagacccatttcctcagagcaacgcaccaatcatggatgaagaaagggaaatccctgagcgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggctgagagggttatagaccccagacgctgcatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggacgccattgatggtgaataccgcttgagaggagaagcgaggaaaacatttgtggacctaatgagaagaggagacctaccagtctggctagcctacagagtggcagctgaaggtatcaactacgcagacaggagatggtgctttgatggagtcaagaacaaccaaatcttggaagaaaatgtggaagtggaaatttggacaaaagaaggagaaaggaagaaattaaaacccagatggttagatgctaggatctactctgacccactggcgctcaaagaattcaaggaattcgcagctggaagaaaatccctaaccttgaatctaatcaccgagatgggtaggctcccaaccttcatgacccagaaagcaaggaatgcattggacaacttagcagtcctgcatacggctgaagcaggcggaagggcgtacaatcatgctcttagtgaactgccggagactctggagacattgcttttactgacacttttggccacagtcacgggcggaatcttcctgttcttgatgagtggaaagggtatagggaagatgaccctgggaatgtgctgcataatcacggccagtattctcctatggtatgcacaaatacagccacactggatagcagcttcaataatactggagttttttctcatagtcttgctcattccagaaccagaaaaacagagaacaccccaagataaccaattaacttatgttgtcatagccatccttacagtggtggccgcaaccatggcaaacgagatgggtttcctggaaaaaacaaagaaagatttcggattgggaagcattacaacccagcaacctgagagcaacatcctggacatagatctacgtcctgcatcagcttggactctatatgccgtggcaacaactttcattacaccaatgttgagacatagcattgaaaattcctcagtgaatgtgtctctaacagccattgccaaccaagccacagtgttaatgggtcttgggaaaggatggccattgtcaaaaatggacatcggagttccccttctcgctatcggatgctattcacaagtcaaccccataactctcacagcagcccttctcttattggtggcacattacgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtcactcaagtattgatgatgaggactacatgggctttatgtgaagctctaaccttagcgaccgggcccatctctacactgtgggaaggaaatccagggagattttggaatacaaccattgcagtgtcaatggccaacatttttagagggagttacctggccggagccggacttctcttttctatcatgaagaacacggccaacacaagaagaggaactggcaacacaggagagacgcttggagagaaatggaaaaaccggttgaatgcattggggaagagtgaattccagatctataagaaaagtggaatccaggaagtggatagaaccttagcaaaagaaggcatcaaaagaggagaaacggaccatcacgctgtgtcacgaggctcggcgaaactgagatggttcatcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggctggaatctggtgcgtcttcaaagtggagttgatgtcttttttactccgccagaaaaatgtgacacattgctgtgtgacataggggagtcgtcaccaaaccccacggttgaggcaggacggacactcagagttctaaacttagtggaaaactggctgaacaacaacacccaattttgcataaaggttctcaacccatacatgccttcagtcatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggctacatacgagccagatgttgatctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccacggcagttacgaaacaaaacagactggatcagcatcatccatggtgaacggagtggttaggctgctaacaaaaccttgggacgtcatccctatggtgacacagatggcaatgacagacacgactccgtttggacaacagcgcgttttcaaagagaaagtggacacgagaacccaagaaccgaaagaagggacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcagattaacgtaccaaaacaaggtggtgcgtgtgcaaagaccgacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcacctgacagtcacagaagaaattgcagtgaaaaactggttagtaagagtggggcgtgagaggttatcaagaatggccattagtggagatgattgtgttgtgaaacccttagatgacaggtttgcaagtgctctaacagctctaaatgacatgggaaaggttaggaaagacatacaacaatgggaaccttcaagaggatggaacgactggacacaagtgcccttttgttcacaccatttccatgagttaatcatgaaggacggtcgtgtactcgtagttccatgtagaaaccaagatgaactgattggtagggcccgaatttcccagggagccgggtggtccttgcgggaaacagcctgtttggggaagtcttacgcccaaatgtggagcctgatgtacttccacagacgtgacctcaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccaatagaatcatgggaggaaatcccatatttggggaaaagagaagaccaatggtgcggctcactgattgggctaacaagcagggccacctgggcaaagaacatccaaacagcaataaatcaagttagatccctaataggcaatgaggaatacacagactacatgccatccatgaaaagattcagaagagaagaggaagaagcaggagtattgtggtag

SEQ ID NO: 7079 - RNA, 9876 nt, synthetic construct
  misc_feature 1..9876: note = derived and/or modified CDS sequence (wt) from DENV-2__JN851118__SS-prME
  source 1..9876: mol_type = other RNA
actgcaggtataattattatgatgatcccaacagtgatggcgttccatttaaccacacgcaacggagaaccacacatgatcgttagtagacaagagaaggggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatcccgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacagcccagtcaacatagaagcagaacctccatttggagacagctacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggtagtgggatctttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaagcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcattagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagctacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgctatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcactacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtacaacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7080 - RNA, 9876 nt, synthetic construct
  misc_feature 1..9876: note = derived and/or modified CDS sequence (wt) from DENV-2__JN851124__SS-prME
  source 1..9876: mol_type = other RNA
accgcaggtataattattatgatgattccaacagtgatggcgttccatttaaccacacgcaacggagaaccacacatgatcgtcagtagacaagagaaaggaaaaagtcttctgtttaaaacagagaacggtgtgaacatgtgcaccctcatggccatggaccttggtgaactgtgtgaagacacaatcacttataattgtcctcttctcaagcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacacgcccagagaattgaaacttgggtcatgagacatccaggcttcaccgtaatggcagcaatcctggcatacaccataggaacgacatatttccaaagagtcctgattttcatcttgctgacagctgtcgctccttcaatgacaatgcgttgtataggaatatcaaatagagactttgtggaaggggtttcaggaggaagctgggttgacatagtcttggaacatggaagctgtgtgacgacgatggcgaagaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaaaggaggcatcgtgacctgtgcaatgttcacatgtaaaaagaacatggaaggaaaagtcgtgcaaccagaaaatttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggtctcgacttcaatgagatggtgttgctgcaaatggaaaacaaagcttggctggtgcacaggcaatggttcttagacctgccgttaccatggctgcccggagcagacacacaaggatcaaactggatacagaaggagacattggtcactttcaaaaatccccatgcaaagaaacaggatgttgttgttttaggatcccaagaaggggctatgcatacagcactcacaggggccacggaaatccagatgtcgtcaggaaacttactgttcacaggacatcttaagtgcaggttgagaatggacaaactacagctcaaaggaatgtcatattccatgtgtacaggaaagtttaaagttgtgaaggaaatagcagaaacacaacatggaacaatagttatcagagtacaatatgaaggggacggttctccgtgcaagatcccttttgaaataatggacttggaaaaaagacatgtcttaggtcgcctgattacagtcaacccaattgtcacagaaaaagacagcccagtcaacatagaagcagaacctccattcggagacagctatatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgtagcacctcactgtctgtgtcattagtattagtgggggtcgtgacactgtatttgggagttatggtgcaggccgatagtggttgtgttgtgagttggaaaaacaaagaactgaaatgtggcagtgggatttttattacagacaacgtgcacacatggacagaacaatacaaattccaaccagaatccccttcaaagctggcttcagctattcagaaggctcatgaagaaggcatttgtggaatccgctcagtaacaagactggagaatctgatgtggaaacaaataacaccagaactgaatcacattctatcagaaaatgaggtaaagatgactatcatgacaggagacattaaaggaattatgcaggcaggaaaacgatccctgcggcctcaacccactgagctgaagtactcttggaaagcatggggcaaagcgaaaatgctctccacagaacttcataaccacacctttctcattgatggccccgaaacagcagaatgtcccaacacaaacagagcttggaactcactagaagttgaagactatggctttggagtattcaccactaacatatggctgaaattgaaagaaaggcaggatgtatcttgtgactcaaaactcatgtcagcagccataaaggacaacagagccgtccacgccgacatgggttattggatagaaagcgcactcaatgacacatggaagattgagaaagcctctttcattgaagttaaaagctgccactggccaaagtcacacaccctctggagtaatggagtgctagaaagtgagatgataattccaaagaattttgcaggaccagtatcacaacacaattatagaccaggctatcatacacaaacggcaggaccctggcatctaggtaggcttgagatggactttgatttctgcgaaggaaccacagtggtggtgactgaggactgtggaaatagaggaccctctttaagaacaaccactgcttctggaaaactcataacagagtggtgctgccgatcttgcacattaccaccactaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctaccatgacggatgacataggcatgggcgtgacttatcttgccctattagcagccttcaaagtcagaccaacttttgcagctggactactcttaagaaagctgacctccaaggaattgatgatgaccaccataggaatcgtactcctctcccagagcaccataccagagactatacttgaactgactgacgcgttggctttagggatgatggttcttaaagtagtgagaaacatggaaaagtaccaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaacgaggctattatggcagtcgggatggtgagcattttagccagttctctcttaaaaaatgatattcccatgacaggaccattagtggctggagggcttctcactgtgtgttacgtgctcactggaagatcggctgatttggaactggagagagctgctgacgtaagatgggaagaacaagcagagatatcaggaagtagtccaattctatcgataacaatatcggaagatggtagcatgtcgataaaaaatgaagaagaagaacaaacactgaccatactcattagaacaggactgctggtgatatcaggactttttcccgtgtcaataccaatcacggcagctgcatggtacctgtgggaagtgaaaaaacaacgagcaggagtattgtgggatgtcccttcacccccacctgtgggaaaggctgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggcgccgtgtctctggacttttctcctggaacgtcaggatctccaatcgtcgacaaaaaaggaaaagttgtgggcctttatggtaacggtgtcgtcacaaggagtggaacatatgtgagtgccatagcccagactgaaaaaagcatcgaagacaatccagagattgaagatgacatctttcgaaagaaaagattgaccatcatggaccttcacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaacccgagtagagatgggtgaagcagctgggatttttatgacagctacccccccaggaagcagagacccatttcctcagagcaatgcaccaatcatggatgaagaaagggaaatccctgagcgttcgtggaactctggacatgagtgggtcacggattttaaagggaagactgtttggtttgttccaagtataaaagcagggaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggccgagagggttatagaccccagacgctgcatgaaaccagtaatactaacagatggtgaagagcgggtaatcttggcaggacccatgccagtgacccactctagtgcagcacaaagaagagggagagtaggaagaaatccaaaaaatgaaagtgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggacgccattgatggtgaataccgcttgagaggagaagcgaggaaaactttcgtggacctaatgagaagaggagacctaccagtctggctagcctacagagtggcagctgaaggtatcaactacgcagacagaagatggtgctttgatggagtcaagaacaaccaaatcttggaagaaaatgtggaagtggaaatttggacaaaagaaggagaaaggaagaaattaaaacccagatggttggatgctaggatctattctgacccactggcgctcaaagaattcaaggaattcgcagctggaagaaagtccctgaccctgaatctaatcacagagatgggtaggctcccaaccttcatgacccagaaagcaaggaatgcactggacaacttagcagtcctgcacacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtagctgcaaccatggcaaacgagatgggtttcctggaaaaaacaaagaaagattttggattgggaagcagtacaacccagcaacatgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagttccccttctcgccatcgggtgctattcacaagtcaaccccataactctcacagcagcccttctctcattggtagcacattatgccatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagctgggacaagtaatgctcttagtcctctgcgtgactcaagtgttgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttctctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaaaagaggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacctattcccatgtcaacatacggttggaatctggtgcgtcttcaaagtggagttgatgttttttttactccgccagaaaagtgtgacacattgctgtgtgacataggggagtcatcaccaaaccccacggttgaggcaggaagaacactcagagttctaaacttagtggaaaattggctgaacaacaacacccaattttgcataaaggttctcaacccatatatgccctcagttatagaaaaaatggaagcgctacaaaggaaatacggaggagctttggtgagaaatccactctcacgaaattccacacacgagatgtactgggtatccaatgcttccgggaacatagtgtcatcagtgaacatgatttcaagaatgttaattaacagattcacaatgagacacaagaaggtcacatacgagccagatgttgacctcggaagtggaactcgcaatatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggatgtcatccccatggtgacacagatggcaatgacagacacgactccatttggacaacagcgcgttttcaaagagaaggtggacacgagaacccaagaaccgaaagaaggcacgaaaaagctaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggagttggttgacaaggaaaggaatctccatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtacaaagaccaacaccaagaggcacagtaatggacattatatcgagaagagaccaaagaggtagtggacaagttgtcacttatggcctcaatactttcaccaacatggaagcccaactgatcagacagatggagggagaaggagtcttcaaaagcatccagcaactgacagccacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacagcaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtccttgcgggaaacagcctgtttggggaagtcttacgcccaaatgtggagcctgatgtacttccacagacgcgatcttaggctggcggcaaatgccatttgctcggcagtcccatcacactgggttccaacaagtcgaacaacctggtccatacacgccacacatgagtggatgacaacagaagacatgctgacagtctggaacagggtgtggatccaagaaaacccatggatggaagacaagactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaagaggaagaggcaggagtcttgtggtag

SEQ ID NO: 7081 - RNA, 9876 nt, synthetic construct
  misc_feature 1..9876: note = derived and/or modified CDS sequence (wt) from DENV-2__JN851114__SS-prME
  source 1..9876: mol_type = other RNA
actgcaggtataattattatgatgatcccaacagtgatggcgttccatttaaccacacgcaacggagaaccacacatgatcgttagtagacaagagaaggggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatcccgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaactggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagcttaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacagcccagtcaacatagaagcagaacctccatttggagacagctacatcattataggagtagaaccaggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaagcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggccatcttgtgcgtcccaaatgcagtgatattgcaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcattagaacaggactactggtgatatcaggactttttcctgtgtcaataccaatcacggcagctgcatggtacctttgggaagtgaaaaaacaacgagcaggagtattgtgggatgtcccttcacccccacctgtggaaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagctacccctcctggaagcagagacccatttccccagagcaatgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgctatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggagagaaatggaaaaaccggttgaatgcattagggaagagtgaattccagatctacaagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcactacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactacgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagttaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccattttcatgagttaatcatgaaggacggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7082 - RNA, 9876 nt, synthetic construct
  misc_feature 1..9876: note = derived and/or modified CDS sequence (wt) from DENV-2__JN851126__SS-prME
  source 1..9876: mol_type = other RNA
actgcaggtataattattatgatgattccaacagtgatggcgttccatttaaccacacgcaacggagaaccacacatgatcgtcagtagacaagagaaagggaaaagtcttctgttcaaaacagagaacggtgtgaacatgtgtaccctcatggccatggaccttggtgaactgtgtgaagacacaatcacttataattgtcctcttctcaagcagaatgaaccagaagacatagactgttggtgcaactctacgtctacatgggtaacttatgggacatgcaccgccacaggagaacacagaagggaaaaaagatcagtagcactcgttccacatgtgggaatgggactggagacacgaactgaaacatggatgtcatcagaaggggcctggaaacatgcacagagaattgaaacttgggtcttgagacatccaggcttcaccataatggcagctatcctggcatacaccataggaacaacatatttccaaagagtcctgattttcatcttactgacagctgtcgctccttcaatgacaatgcgttgtataggaatatcaaatagagactttgtggaaggggtttcaggaggaagctgggttgatatagtcttggaacatggaagctgtgtgacgacgatggcgaaaaataaaccaacattggattttgaactgataaagacagaagccaaacatcccgccactctaaggaagtattgtattgaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaattgtgcaaccagaaaacttggagtacaccattgtgataacacctcactcaggggaagagaatgcagtcggaaatgacacaggaaaacacggcaaggaaattaaagtaacaccacagagttccattacagaagcagaactaacaggctatggcactgtcacgatggaatgctctccgagaacgggcctcgacttcaatgagatggtgttgctgcagatggaaaacaaggcttggctggtgcacaggcaatggttcttagacctgccattaccatggctgcccggagcagacacacaaggatcaaattggatacagaaggagacattggtcactttcaaaaatccccatgcaaagaaacaggatgttgttgttttaggatcccaagaaggggctatgcacacagcactcacaggggccacggaaatccagatgtcatcaggaaacttactgttcacaggacatcttaaatgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaattgtcacagaaaaggacagcccagtcaacatagaagcagaacctccattcggagacagctacatcattataggagtagagccgggacaactgaagcttagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgctttcagtggagtttcatggactatgaaaatcctcataggagtcgtcatcacatggataggaatgaattcacgcagcacctcactgtctgtgtcactagtattagtgggagtcgtgacattgtatttgggggttatggtgcaggccgatagtggttgcgttgtgagttggaaaaacaaagaactgaaatgtggcagtgggatttttattacagacaacgtgcacacatggacagaacaatacaaattccaaccagaatccccttcaaagctagcttcagctatccagaaggctcatgaagagggcatttgtggaatccgctcagtaacaagactggagaatctgatgtggaaacaaataacaccagaactgaatcacattctatcagaaaatgagataaagttgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaatacaaacagagcttggaactcgctagaagttgaagactatggttttggagtattcaccaccaacatatggctgaaattgaaagaaaggcaggatgtattttgtgactcaaaactcatgtcagcagccataaaagacaacagagccgtccacgccgatatgggttattggatagaaagcgcactcaatgacacatggaagattgagaaagcctcttttattgaagttaaaagctgccactggccaaagtcacatactctctggagtaatggagtgctagaaagtgagatgataattccaaagaattttgcaggaccagtgtcacaacacaattacagaccaggctatcatacacagacggcaggaccctggcatctaggcaggcttgagatggactttgatttctgcgaaggaaccacagtggtggtgactgaggattgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttaggaatggcattgttcctggaagagatgctcaggacccgagtaggaacgaaacacacaatattactagttgcagtctcttttgtgacattgatcacagggaacatgtcttttcgagatttggggagagtggtggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaatcgtactcctctctcagagcaccataccagagactatacttgaactgactgacgcgttggctttggggatgatggttctcaaaatagtaagaaacatggaaaagtatcaactagcagtgactattatggctatcttgtgcgtcccaaatgcagtgatattacaaaacgcatggaaagtgagctgcacagcactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccattaaatgaggctattatggcagtcgggatggtgagcattttagccagttctctcttaaagaatgatattcccatgacaggaccattagtggctggagggcttctcactgtgtgttacgtgcttactggaagatcggctgatttggaactggagagagctgctgacgtaagatgggaagaacaggcagagatatcaggaagcagtccaattctgtcgataacaatatcggaagatggtagcatgtcgataaaaaatgaagaagaagaacaaacactgaccatactcatcagaacaggactgctggtgatatcaggactttttcccgtgtcaataccaatcacggcagctgcatggtacctgtgggaggtgaaaaaacaacgagccggagtattgtgggatgtcccttcacctccacctgtgggaaaggccgaactggaagatggagcctatagaatcaaacagaaagggattctagggtactcgcagatcggagccggagtttacaaagaaggaacattccacacaatgtggcatgtcacacgtggtgctgttctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgttcaaacaaaacccggtctttttaaaactaacactggaaccataggcgccgtatctctggacttttctcccggaacgtcaggatctccaatcgtcgacaaaaaaggaaaagttgtgggcctttatggcaacggtgtcgtcacaaggagtggaacatatgtaagtgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctagcccccactagagttgtggcggccgaaatggaagaagctctcagaggacttccaataagataccaaaccccagctatcagagctgagcacactggacgggagattgtggatctaatgtgtcacgccacatttaccatgaggctactatcaccaattagagtgccaaattacaacctgattattatggatgaagcccatttcacagacccagcaagcatagcagctagaggatacatttcaactcgagtagagatgggtgaagcagctgggattttcatgacagctacccctcccggaagcagagacccatttcctcagagcaacgcaccaatcatggatgaagaaaaggaaatccctgagcgttcgtggaactctggacatgagtgggttacggattttaaagggaagactgtttggtttgttccaagtataaaagcaggaaatgacatagcagcttgcctgagaaagaatggaaagaaagtgatacaactcagcaggaagacctttgattctgaatatatcaagactaggaccaacgattgggactttgtggtcacgacagacatttcagaaatgggtgctaacttcaaggctgagagggttatcgaccccagacgctgcgtgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggacgccattgacggtgaataccgcttgagaggagaagcgaggaaaacatttgtggacctaatgagaagaggagacctaccagtctggctagcctacagagtggcagctgaaggtatcaactacgcagacaggagatggtgctttgatggagtcaagaacaaccaaatcttggaagaaaatgtggaagtggaaatttggacaaaagaaggagaaaggaagaaattaaaacccagatggttagatgccaggatctactctgacccactggcgctcaaagaattcaaggaattcgcagctggaagaaaatccctaaccttgaatctaatcaccgagatgggtaggctcccaaccttcatgacccagaaagcaaggaatgcattggacaacttagcagtcctgcatacggctgaagcaggcggaagggcgtacaatcatgctcttagtgaactgccggagactctggagacattgcttttactgacacttttggccacagtcacgggcggaatcttcctgttcttgatgagtggaaagggtatagggaagatgaccctgggaatgtgctgcataatcacggccagtattctcctatggtatgcacaaatacagccacactggatagcagcttcaataatactggagttttttctcatagtcttgctcattccagaaccagaaaaacagagaacaccccaagataaccaattaacttatgttgtcatagccatccttacagtggtggccgcaaccatggcaaacgagatgggtttcctggaaaaaacaaagaaagatttcggattgggaagcattacaacccagcaacctgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagttccccttctcgctatcggatgctattcacaagtcaaccccataactctcacagcagcccttctcttattggtggcacattacgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtcactcaagtattgatgatgaggactacatgggctttatgtgaagctctaaccttagcgaccgggcccatctctacactgtgggaaggaaatccagggagattttggaatacaactattgcagtgtcaatggccaacatttttagagggagttacctggccggagccggacttctcttttctatcatgaagaacacggccaacacaagaaggggaactggcaacacaggagagacgcttggagagaaatggaaaaaccggttgaatgcattggggaagagtgaattccagacctataagaaaagtggaatccaggaagtggatagaaccttagcaaaagaaggcatcaaaagaggagaaacggaccatcacgctgtgtcacggggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggctggaatctggtgcgtcttcaaagtggagttgatgtcttttttactccgccagaaaaatgtgacacattgctgtgtgacataggggagtcgtcaccaaaccccacggttgaggcaggacggacactcagagttctaaacttagtggaaaactggctgaacaacaacacccaattttgcataaaggttctcaacccatacatgccttcggtcatagaaaaaatggaaacgctgcaaaggaaacacggaggagctttggtgaggaatccactctcacgaaattccacacacgagatgtactgggtatctaatgcttccgggaacatagtgtcatcagtgaacatgatttcaagaatgttgattaacagattcacaatgagacataagaaagccacatacgagccagatgttgatctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccacggcagctacgaaacaaaacagactggatcagcatcatccatggtgaacggagtggttaggctgctaacaaaaccttgggacgtcatccctatggtgacacagatggcaatgacagacacgactccgtttggacaacagcgcgtcttcaaagagaaagtggacacgagaacccaagaaccgaaagaagggacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaaatcggcacgtgaggctgttgaagacagtagattttgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcagattaacgtaccaaaacaaggtggtgcgtgtgcaaagaccgacaccaagaggcacagtaatggacattatatcgagaagagaccaaagaggtagtggacaagtagtcacctacggcctcaatactttcaccaacatggaagcccaactgatcagacagatggagggagaaggagtattcaaaagcatccagcacctgacagtcacagaagaaattgcagtgaaaaactggttagtaagagtggggcgtgagaggttatcaagaatggccatcagtggagatgattgtgttgtgaaacccttagatgacaggtttgcaagtgctctaacagctctgaatgacatgggaaaggttaggaaagacatacaacaatgggaaccttcaagaggatggaacgactggacacaagtgcccttttgttcacaccatttccatgagttaatcatgaaggacggtcgtgtactcgtagttccatgtagaaaccaagatgaactgattggtagggcccgaatttcccagggagccgggtggtccttgcgggaaacagcctgtttggggaagtcttacgcccaaatgtggagcttgatgtacttccacagacgtgacctcaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaaaagagaagaccaatggtgcggctcactgattgggctaacaagcagggccacctgggcaaagaacatccaaacagcaataaatcaagttagatccctaataggcaatgaggaatacacagactacatgccatccatgaaaagattcagaagagaagaggaagaagcaggagtattgtggtag

SEQ ID NO: 7083 - RNA, 9876 nt, synthetic construct
  misc_feature 1..9876: note = derived and/or modified CDS sequence (wt) from DENV-2__JN851121__SS-prME
  source 1..9876: mol_type = other RNA
actgcaggtataattattatgatgatcccaacagtgatggcgttccatttaaccacacgcaacggagaaccacacatgatcgttagtagacaagagaaggggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatcccgccactctaaggaagtattgtgtagaggcaaagctgaccaacacaacaacagcatctcgctgcccaacacaaggagaacctagcctaaacgaagaacaggacaaaagattcgtctgcaaacactctatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacagcccagtcaacatagaagcagaacctccatttggagacagctacatcattataggagtagaaccaggacaactgaagctcagctggtttaagaaaggaagttctattggccaaatgtttgagacgacaatgagaggagcgaagagaatggccattttaggtgacacagcttgggattttggatccctgggaggagtgttcacatctataggaaaggccctccaccaagtctttggagctatctatggggctgccttcagcggggtttcatggactatgaaaatcctcataggagtcgtcatcacatggataggaatgaattcacgcagcacctcactgtctgtgtcactagtattagtgggggtcgtgacattgtatttgggagctatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaagcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactgatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcattagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagctacccctcctggaagcagagacccatttccccagagcaatgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcgcaaagaagagggagagtaggaagaaatccaaaaaatgaaaatgaccagtacatatacatgggggaacctctggaaaatgatgaagactgtgcacactggaaagaagccaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaattttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcatcacaaaccagcaacctgagagtaacatcctggacatagatctacgtcctgcatcagcttggactctatatgccgtggcaacaactttcatcacaccaatgttgaggcatagcattgaaaactcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgctatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggatagaaccttagcaaaagaaggcatcaaaagaggagaaacggaccatcacgctgtgtcgcgaggctcagcaaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcactacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacacgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcaccgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagttaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7084 - RNA, 9876 nt, synthetic construct
  misc_feature 1..9876: note = derived and/or modified CDS sequence (wt) from DENV-2__JN851115__SS-prME
  source 1..9876: mol_type = other RNA
actgcaggtataattattatgatgatcccaacagtgatggcgttccatttaaccacacgcaacggagaaccacacatgatcgttagtagacaagagaaggggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatcccgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggctcttagacctgccgttaccatggctgcccggagcagacacacaaggatcaaattggatacagaaggagacactggtcactttcaaaaatccccatgcaaagaaacaggatgttgttgttttaggttcccaagaaggagccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacagcccagtcaacatagaagcagaacctccatttggagacagctacatcattataggagtagaaccaggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaagcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagaatggtgctgccgatcttgcacattaccaccgctaaggtacagaggtgaggatggatgctggtatggtatggaaatcaggccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggccatcttgtgcgtcccaaatgcagtgatattgcaaagcgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcattagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagtagtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagctacccctcctggaagcagagacccatttccccagagcaatgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgctatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggagagaaatggaaaaaccggttgaatgcattagggaagagtgaattccagatctacaagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcactacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaaactaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagttaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggctatgaggaatacacagactacatgccatctatgaaaagattcagaagagaagaggaagaggcaggagtcttgtggtag

SEQ ID NO: 7085 - RNA, 9876 nt, synthetic construct
  misc_feature 1..9876: note = derived and/or modified CDS sequence (wt) from DENV-2__JN851127__SS-prME
  source 1..9876: mol_type = other RNA
actgcaggtataattattatgatgattccaacagtgatggcgttccatttaaccacacgcaacggagaaccacacatgatcgtcagtagacaagagaaagggaaaagtcttctgttcaaaacagagaatggtgtgaacatgtgtaccctcatggccatggaccttggtgaactgtgtgaagacacaatcacttataattgtcctcttctcaagcagaatgaaccagaagacatagactgttggtgcaactctacgtctacatgggtaacttatgggacatgcaccgccacaggagaacacagaagggaaaaaagatcagtagcactcgttccacatgtgggaatgggactggagacacgaactgagacatggatgtcatcagaaggggcctggaaacatgcacagagaattgaaacttgggtcttgagacatccaggcttcaccataatggcagctatcctggcatacaccataggaacaacatatttccaaagagtcctgattttcatcttactgacagctgtcgctccttcaatgacaatgcgttgtataggaatatcaaatagagactttgtggaaggggtttcaggaggaagctgggttgatatagtcttggaacatggaagctgtgtgacgacaatggcgaaaaataaaccaacattggattttgaactgataaagacagaagccaaacatcccgccactctaaggaagtattgtattgaggcaaagctgaccaacacaacaacagcatctcgctgcccaacacaaggagaacctagcctaagtgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaattgtgcaaccagaaaacttggagtacaccattgtgataacacctcactcaggggaagagaatgcagttggaaatgacacaggaaaacacggcaaggaaattaaagtaacaccacagagttccattacagaagcagaactaacaggctatggcactgtcacgatggaatgctctccgagaacgggcctcgacttcaatgagatggtgttgctgcagatggaaaacaaggcttggctggtgcacaggcaatggttcttagacttgccattaccatggctgcccggagcagacacacaaggatcaaattggatacagaaggagacattggtcactttcaaaaatccccatgcaaagaaacaagatgttgttgttttaggatcccaagaaggggctatgcacacagcactcacaggggccacggaaatccagatgtcatcaggaaacttactgttcacaggacatcttaaatgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaattgtcacagaaaaggacagcccagtcaacatagaagcagaacctccattcggagatagctacatcattataggagtagagccgggacaactgaagcttagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgctttcagtggagtttcatggactatgaaaatcctcataggagtcgtcatcacatggataggaatgaattcacgcagcacctcactgtctgtgtcactagtattagtgggagtcgtgacattgtatttgggggttatggtgcaggccgatagtggttgcgttgtgagttggaaaaacaaagaactgaaatgtggcagtgggattttcattacagacaacgtgcacacatggacagaacaatacaaattccaaccagaatccccttcaaagttggcttcagctatccagaaggctcatgaagagggcatttgtggaatccgctcagtaacaagactggagaatctgatgtggaaacaaataacaccagaactgaatcacattctatcagaaaatgagataaagttgactatcatgacaggagacattaaaggaatcatgcaggcaggaaaacgatccctgcggcctcaacccattgagctgaagtactcttggaaagcatggggcaaagcgaaaatgctctccacagagcttcataaccacacctttctcattgatggccccgaaacagcagaatgtcccaatacaaacagagcttggaactcactagaagttgaagactatggttttggagtattcaccaccaacatatggctgaaattgaaagaaaggcaggatgtattttgtgactcaaaactcatgtcagcagtcataaaagacaacagagccgtccacgccgatatgggttattggatagaaagcgcactcaatgacacatggaagattgagaaagcctcttttattgaagttaaaagctgccactggccaaagtcacatactctctggagcaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaaccacagtggtggtgactgaggattgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtctctttcgtgacattgatcacagggaacatgtcttttcgagatttggggagagtgatggtcatggtgggcgctactatgacggatgacataggcatgggcgtgacctatcttgccctattagcagccttcaaagtcagaccaacttttgcagctggactactcttaagaaagctgacctccaaggaattgatgatgaccaccataggaatcgtactcctctctcagagcaccataccagagactatacttgaactgactgacgcgttggctttggggatgatggttctcaaaatagtaagaaacatggaaaagtatcaactagcagtgactatcatggctatcttgtgcgtcccaaatgcagtgatattacaaaacgcatggaaagtgagctgcacaacactggcagtggtgtccgtttccccactgcttttaacatcctcacggcagaaagcggattggataccactggcgttgacgatcaaaggcctcaatccaacagccattttcttaacaaccctctcaagaactagcaagaaaaggagctggccattaaatgaggctattatggcagtcgggatggtgagcattttagccagttctctcttaaagaatgatattcccatgacaggaccattagtggctggagggcttctcactgtgtgttacgtgcttactggaagatcggctgatttggaactggagagagctgctgacgtaagatgggaagaacaggcagagatatcaggaagcagtccaattctgtcgataacaatatcggaagatggtagcatgtcgataaaaaatgaagaagaagaacaaacactgaccatactcattagaacaggactgctggtgatatcaggactttttcccgtgtcaataccaatcacggcagctgcatggtacctgtgggaggtgaaaaaacaacgagccggagtattgtgggatgtcccttcacctccacctgtgggaaaggccgaactggaagatggagcctatagaatcaagcagaaagggattctagggtactcgcagatcggagccggagtttacaaagaaggaacattccacacaatgtggcatgtcacacgtggtgctgttctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggcgccgtatctctggacttttctcccggaacgtcaggatctccaatcgtcgacaaaaaaggaaaagttgtgggcctttatggcaacggtgtcgtcacaaggagtggaacatatgtaagtgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaattctagcccccactagagttgtggcggccgaaatggaagaagctctcagaggacttccaataagataccaaaccccagctatcagagctgagcacactggacgggagattgtggatctaatgtgtcacgccacatttaccatgaggctactatcaccaattagagtgccaaattacaacctgattatcatggatgaagcccatttcacagacccagcaagcatagcagctagaggatacatctcaactcgagtagagatgggtgaagcagctgggattttcatgacagctacccctcctggaagcagagacccatttcctcagagcaacgcaccaatcatggatgaagaaagggaaatccctgagcgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggctgagagggttatagaccccagacgctgcatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggacgccattgatggtgaataccgcttgagaggagaagcgaggaaaacattcgtggacctaatgagaagaggagacctaccagtctggctagcctacagagtggcagctgaaggtatcaactacgcagacaggagatggtgctttgatggagtcaagaacaatcaaatcttggaagaaaatgtggaagtggaaatttggacaaaagaaggagaaaggaagaaattaaaacccagatggttagatgctaggatctactctgacccactggcgctcaaagaattcaaggaattcgcagctggaagaaaatccctaaccttgaatctaatcaccgagatgggtaggctcccaaccttcatgacccagaaagcaaggaatgcattggacaacttagcagtcctgcatacggctgaagcaggcggaagggcgtacaatcatgctcttagtgaactgccggagactctggagacattgcttttactgacacttttggccacagtcacgggcggaatcttcctgttcttgatgagtggaaagggtatagggaagatgaccctgggaatgtgctgcataatcacggccagtattctcctatggtatgcacaaatacagccacactggatagcagcttcaataatactggagttttttctcatagtcttgctcattccagaaccagaaaaacagagaacaccccaagataaccaattaacttatgttgtcatagccatccttacagtggtggccgcaaccatggcaaacgagatgggtttcctggaaaaaacaaagaaagatttcggattgggaagcattacaacccagcaacctgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagttccccttctcgctatcggatgctattcacaagtcaaccccataactctcacagcagcccttctcttattggtggcacattacgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtcactcaagtattgatgatgaggactacatgggctttatgtgaagctctaaccttagcgaccgggcccatctctacactgtgggaaggaaatccagggagattttggaatacaaccattgcagtgtcaatggccaacatttttagagggagttacctggccggagccggacttctcttttctatcatgaagaacacggccaacacaagaaggggaactggcaacacaggagagacgcttggagagaaatggaaaaaccggttgaatgccttggggaagagtgaattccagatctataagaaaagtggaatccaggaagtggatagaaccttagcaaaagaaggcatcaaaagaggagaaacagaccatcacgctgtgtcacgaggctcggcgaaactgagatggttcatcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggctggaatctggtgcgtcttcaaagtggagttgacgtcttttttactccgccagaaaaatgtgacacattgctgtgtgacataggggagtcgtcaccaaaccccacggttgaggcaggacggacactcagagttctaaacttagtggaaaactggctgaacaacaacacccaattttgcataaaggttctcaacccatacatgccttcagtcatagaaaaaatggaagcgctgcaaaggaaatacggaggagctttggtgaggaatccactctcacgaaattctacacacgagatgtactgggtatccaatgcttccgggaacatagtgtcatcagtgaacatgatttcaagaatgttgattaacagattcacaatgagacataagaaggctacatacgagccagatgttgatctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccacggcagttacgaaacaaaacagactggatcagcatcatccatggtgaacggagtggttaggctgctaacaaaaccttgggacgtcatccctatggtgacacagatggcaatgacagacacgactccgtttggacaacagcgcgttttcaaagagaaagtggacacgagaacccaagaaccgaaagaagggacgaaaaaactaatgaaaatcacggcagaatggctctggaaagaactaggaaagagaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagtacacaagaaacttgctgaagccattttcagattaacgtaccaaaacaaggtggtgcgtgtgcaaagaccgacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcacctgacagtcacagaagaaattgcagtgaaaaactggttagtaagagtggggcgtgagaggttatcaagaatggccattagtggagatgattgtgttgtgaaacccttagatgacaggtttgcaagtgctctaacagctctaaatgacatgggaaaggttaggaaagacatacaacaatgggaaccttcaagaggatggaacgactggacacaagtgcccttttgttcacaccatttccatgagttaatcatgaaagacggtcgtgtactcgtagttccatgtagaaaccaagatgaactgattggtagggcccgaatttcccagggagccgggtggtccttgcgggaaacagcctgtttggggaagtcttacgcccaaatgtggagcctgatgtacttccacagacgtgacctcaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccaatagaatcatgggaggaaatcccatatttggggaaaagagaagaccaatggtgcggctcactgattgggctaacaagcagggccacctgggcaaagaacatccaaacagcaataaatcaagttagatccctaataggcaatgaggaatacacagactacatgccatccatgaaaagattcagaagagaagaggaagaagcaggagtattgtggtag

SEQ ID NO: 7086 - RNA, 9876 nt, synthetic construct
  misc_feature 1..9876: note = derived and/or modified CDS sequence (wt) from DENV-2__JN851120__SS-prME
  source 1..9876: mol_type = other RNA
actgcaggtataattattatgatgatcccaacagtgatggcgttccatttaaccacacgcaacggagaaccacacatgatcgttagtagacaagagaaggggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccgtaggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatcccgccactctaaggaagtattgtgtagaggcaaagctgaccaacacaacaacagcatcccgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcattcaggggaagagaatgcagtcggaaatgacacaggaaaacatggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacagcccagtcaacatagaagcagaacctccatttggagacagctacatcattataggagtagaaccaggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaagcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggccatcttgtgcgtcccaaatgcagtgatattgcaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcattagaacaggactactggtgatatcaggactttttcctgtgtcaataccaatcacggctgctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagctacccctcctggaagcagagacccatttccccagagcaatgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaggcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaagacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgctatcatagggccaggactccaagcgaaagcaactagagaggctcagaaaagagcagcagcgggcatcatgaaaaacccaactgtggatggaatgacagtgattgacttagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggagagaaatggaaaaaccggttgaatgcattagggaagagtgaattccagatctacaagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcactacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagttaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcctttttgttcacaccatttccatgagttaatcatgaaggacggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaatagaagaggaagaggcaggagtcttgtggtag

SEQ ID NO: 7087 - RNA, 9876 nt, synthetic construct
  misc_feature 1..9876: note = derived and/or modified CDS sequence (wt) from DENV-2__JN851131__SS-prME
  source 1..9876: mol_type = other RNA
actgcaggtgtaatcattatgatgattccaacagtgatggcgttccatttaaccacacgcaacggagaaccacacatgatcgtcagtagacaagagaaagggaaaagtctcctgttcaaaacagagaacggtgtgaacatgtgtaccctcatggccatagaccttggtgaattgtgtgaagacacaatcacttataattgtcctcttctcaggcagaatgaaccagaagacatagactgttggtgcaactctacgtcaacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgctcagagaatcgaaacttgggtcttgagacatccaggctttaccataatggcagcaatcctggcatacaccataggaacgacatatttccaaagagtcctgattttcattttactgacagctgtcgctccttcaatgacaatgcgttgcataggaatatcaaacagagactttgtggaaggggtttcaggaggaagctgggttgacatagtcttagaacatggaagctgtgtgacgacgatggcgaaaaacaaaccaacattggattttgaactgataaaaacggaagccaaacatcccgccactctaaggaagtattgtatagaggcaaagctgactaacacaacaacagcatctcgctgcccaacacaaggagaacctagcttaaaagaagaacaggacaaaaggtttgtctgtaaacactccatggtggacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgatacaggaaaacacggcaaggaaattaaagtaacaccacagagttccattacagaagcagaactgacaggctatggcactgtcacgatggaatgctccccgagaacgggcctcgactttaatgagatggtgttgctgcaaatggaagacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggagccacggaaatccagatgtcatcaggaaacttactgttcacaggacatcttaagtgcaggctgagaatggacaaactacagctcaaaggaatgtcatattctatgtgcacaggaaagtttaaagttgtgaaggaaatagcagaaacacaacatggaacaatagttatcagagtacaatatgaaggggacggttctccgtgtaagatcccttttgaaataatggatttggagaaaagacatgtcttaggtcgcttgatcacagtcaacccaattgtcacagaaaaagacagcccagtcaacatagaagcagaacctccattcggagacagctacatcattataggagtagaaccgggacaactgaaactcagctggtttaagaaaggaagttctattggccaaatgtttgagacaacaatgagaggagcgaagagaatggccattttaggtgacacagcttgggactttggatccctgggaggagtgttcacatctataggaaaggccctccaccaagtctttggagcaatctatggggctgccttcagcggggtttcatggactatgaaaatcctcataggagtcgtcatcacatggataggaatgaattcacgcagcacctcactgtctgtgtcactagtattagtgggggtcgtgacattgtatttgggagtcatggtgcaggccgatagtggttgcgtcgtgagttggaaaaacaaagaactgaaatgtggtagtgggatttttatcacagacaacgtacacacatggacagaacaatacaaatttcaaccagaatccccttcaaagctagcctcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaaacatggggcaaagcaaaaatgctctccacagagcttcataaccacacctttctcattgatggccccgaaacagcagaatgtcccaacacaaacagagcttggaactcactagaagttgaagattatggttttggagtattcaccaccaacatatggctgaaactgaaagaaaggcaggaagtattttgtgactcaaaactcatgtcagcagccataaaagacaatagggccgtccacgccgatatgggttattggatagaaagcgcacttaatgacacatggaagattgagaaagcctctttcattgaagttaaaagctgccactggccaaagtcacacaccctctggagtaatggagtgctagaaagtgagatgataattccaaagaattttgcaggaccagtgtcacagcacaactacaggccaggctatcacacacaaacggcaggaccctggcatctaggtaagcttgagatggactttgatttctgcgaaggaaccacagtggtagtgactgaggactgtggaaacagaggaccctctttaagaacaactactgcttctggaaaactcataacagaatggtgctgccgatcttgcacattaccaccgctaaggtacagaggtgaggatggatgctggtatggaatggaaatcagaccatcgaaagagaaagaagagaacttggtcaactctttggtcacagccggacatggacagattgacaacttctcactaggagtcttgggaatggcattgttcctggaagaaatgctcaggacccgagtaggaacgaaacatgcaatattgctagttgcagtttctttcgtgacattgatcacagggaacatgtcctttcgagatttggggagagtgatggttatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctggctttggggatgatggttctcaaaatagtgagaaacatggaaaagtatcagctagcagtgactatcatggccatcttgtgcgtcccaaatgcagtgatattacaaaacgcatggaaagtgagctgcacaacactggcagtggtgtccgtttccccactgcttttaacatcctcacagcagaaagcggactggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtagctggagggcttctcactgtgtgttacgtgctcactggaagatcggctgatttggaactagagagagctgctgacgtaagatgggaagaacaggcagagatatcaggaagtagtccaattctgtcaataacaatatcggaagatggtagcatgtcgataaaaaatgaagaagaagaacaaacattgaccatactcattaggacaggactgctggtgatatcaggactttttcccgtgtcaataccaatcacggcagctgcatggtacctgtgggaagtgaaaaaacaacgagccggagtattgtgggatgtcccttcacccccacctgtaggaaaggccgaactggaagatggagcctatagaatcaagcagaaagggattctaggatactcgcagatcggggccggagtttacaaagaaggaacattccacacaatgtggcacgtcacacgtggtgctgtcctaatgcataaagggaagagaattgaaccgtcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacactggaaccataggcgccgtatctctggacttttctcctggaacgtcaggatctccaatcgtcgacaaaaaaggaaaagttgtgggcctttatggcaacggcgtcgtcacaaggagtggaacatatgtgagtgccatagcccagactgaaaaaagcattgaagacaatccagagattgaagatgacatctttcgaaagaaaagattgaccatcatggacctccacccaggagcgggaaaaacgaagagataccttccagcaatagtcagagaagccataaaacgaggtttgaggacactaatcctggcccccactagagttgtggcggctgaaatggaagaagctctcagaggacttccaataagataccaaaccccagccatcagagttgagcacactgggcgggagattgtggatctaatgtgtcacgccacatttaccatgaggctgctatccccaattagagtaccaaattacaacctgatcatcatggatgaagcccatttcacagacccagcaagcatagcagctagaggatacatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgagtggatcacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggctgagagggttatagaccccaggcgctgcatgaaaccagtcatactaacagatggtgaagagcgggtgattctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagacaacatcaacacgcctgaaggaatcattcccagcatgttcgaaccagagcgtgaaaaggtggatgctattgatggtgaataccgcttaagaggagaagcaaggaaaacttttgtggacctaatgagaagaggagacctaccagtctggctagcctacagagtggcagctgaaggcatcaactacgcagacagaagatggtgctttgatggagtcaagaacaatcaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtctctgaccctgaatctaatcacagagatgggtaggctcccaaccttcatgacccagaaagcaaggaacgcactagacaatctagcagtcctgcatacggctgaagcaggcggaagggcgtacaatcatgctcttagtgaactgccggagaccctggagacattgcttttattgacactcttggccacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataatcaattaacttatgttgtcatagccatccttacagtggtggcagcaaccatggcaaacgagatgggtttcctggaaaaaacaaagaaagatttcggattgggaagcattgcaatccagcaacctgagagcaacatcctggacatagatctacgccctgcatcagcttggactctatatgctgtggcaacaactttcattacaccaatgctgagacacagcattgaaaattcctcagtgaatgtgtctctaacggccattgccaaccaagccacagtgttaatgggccttgggaaaggatggccattgtcaaaaatggacatcggagttccccttctcgctatcgggtgctattcgcaagttaaccccataactctcacggcagcccttctcttattggtagcacattatgccatcatagggccaggactccaagcgaaagcaactagagaagctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgaccgggcccatttccacactgtgggaaggaaatccagggagattttggaatacaactattgcagtgtcaatggctaacatttttagagggagctacttggccggagccggacttctcttttctatcatgaagaatacggccaacacaagaaggggaactggcaacacaggagagacgcttggagaaaaatggaaaaaccgattgaatgcattggggaagagtgaattccagatctataagaaaagtggaatccaggaggtggatagaaccttagcaaaagaagggatcaaaagaggggaaacggaccatcacgctgtgtcgcgaggctcggcgaaactgagatggttcgtcgagagaaacctggtcacaccagaagggaaagtagtggacctcggttgcggcagggggggctggtcatactattgtgggggactaaagaatgtgaaagaagtcaaaggcctaacaaaaggaggaccaggacacgaagaacccattcccatgtcaacatatggttggaacctggtgcgtcttcaaagtggagttgatgttttttttactccgccagaaaagtgtgacacactgctgtgcgacataggggagtcgtcaccaaaccccacggttgaggcaggacgaacactcagagttctaaacctagtggaaaattggctgaacaacaacacccaattttgcataaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaatagattcacaatgagacataagaaggccacatacgagccagatgttgacctcggaagcggaacccgcaacatcggaattgaaagtgagaaaccaaatctggacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccccatggtgacacagatggcaatgacagacacgactccatttggacaacagcgcgttttcaaagagaaagtggacacaagaacccaagaaccgaaagaaggcacgaaaaaactaatgaaaatcacggctgaatggctctggaaagaactaggaaagaaaaagacacctaggatgtgcaccagagaagaattcacaagaaaggtgagaagcaatgcagccttaggtgccatattcactgatgagaataagtggaagtcggcacgtgaggctgttgaagatagtggattctgggaactggttaacaaggaaaggaatcttcatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccttgagtggagtggaaggagaagggctgcacaagctaggctacattttgagagacgtgagcaaaaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaacatggaagcccaactgatcagacagatggaaggagaaggagtcttcaaaagcatccagcacctgacagtcacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaagttaggaaagacatacaacaatgggaaccttcaagaggatggaacgattggacacaagtgcccttttgttcacaccatttccatgagttaatcatgaaggacggtcgcgtactcgtagttccatgtagaaaccaagatgaactgattggtagggctcgaatttcccagggagccgggtggtctttgcgggaaacagcctgtttggggaagtcttacgcccagatgtggagcctgatgtacttccacagacgtgaccttaggctggcggcaaatgctatttgctcggcagtcccatcacattgggttccaacaagtcgaacgacctggtccatacatgccacacatgagtggatgacaacagaagatatgctgacagtctggaacagggtgtggattcaagaaaacccatggatggaagacaaaactccagtagaatcatgggaagaaatcccatatttggggaaaagagaagaccaatggtgcggctcattgatcgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 7088 - RNA, 9876 nt, synthetic construct
  misc_feature 1..9876: note = derived and/or modified CDS sequence (wt) from DENV-2__JN851122__SS-prME
  source 1..9876: mol_type = other RNA
actgcaggtataattattatgatgatcccaacagtgatggcgttccatttaaccacacgcaacggagaaccacacatgatcgttagtagacaagagaaggggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatcccgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagcttaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacagcccagtcaacatagaagcagaacctccatttggagacagctacatcattataggagtagaaccaggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaagcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggccatcttgtgcgtcccaaatgcagtgatattgcaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagccagttctctcttaaagaatgatattcccatgacaggaccattagtggctggagggcttctcactgtgtgttatgtgctcactggaagatcggctgatttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcattagaacaggactcctggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagctacccctcctggaagcagagacccatttccccagagcaatgcaccaatcatggatgaagaaagagaaatccctgagcgttcgtggaactctggacatgagtgggttacggattttaaagggaagactgtttggtttgttccaagtataaaaacagggaatgatatagcagcttgcctgagaaagaatggaaagaaagtgatacaactcagcaggaaaacttttgattctgaatatattaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtaacccattatgctatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacataggagagacgcttggagagaaatggaaaaaccggttgaatgcattagggaagagtgaattccagatctacaagaaaagtggaatccaggaagtggatagaaccttagcaaaagaaggcatcaaaagaggagagacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccaccagaaaagtgtgacacactgctgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcactacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactacgaccaagaccacccatacaaaacgtgggcctaccatggcagctacgaaacaaaacagactggatcagcatcatccatggtgaacggagtggttaggctgctaacaaagccttgggacgtcatccctatggtgacacagatggcaatgacagacacgactccatttggacaacagcgcgttttcaaagagaaagtggacacgagaacccaagaaccgaaagaaggcacgaaaaaactaatgaaaattacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggtagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggccttaatactttcaccaatatggaagcccaactgatcagacagatggagggagaaggagttttcaaaagcatccagcaactgacagttaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattgggttccaacaagtcgaacaacctggtccatacacgccacacacgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7089 - RNA, 9876 nt, synthetic construct
  misc_feature 1..9876: note = derived and/or modified CDS sequence (wt) from DENV-2__JN851116__SS-prME
  source 1..9876: mol_type = other RNA
actgcaggtataattattatgatgatcccaacagtgatggcgttccatttaaccacacgcaacggagaaccacacatgatcgttagtagacaagagaaggggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatcccgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacagcccagtcaacatagaagcagaacctccatttggagacagctacatcattataggagtagaaccaggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaagcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaacgcatggaaagtgagctgcacaatactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcattagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagctacccctcctggaagcagagacccatttccccagagcaatgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcctagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctagaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgctatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcactacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagttaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7090 - RNA, 9876 nt, synthetic construct
  misc_feature 1..9876: note = derived and/or modified CDS sequence (wt) from DENV-2__GU370051__SS-prME
  source 1..9876: mol_type = other RNA
actgcaggtataattattatgatgatcccaacagtgatggcgttccatttaaccacacgcaacggagaaccacacatgatcgttagtagacaagagaaggggaaaagtctcctgtttaaaacagagaacggtgtgaacatgtgtaccctcatggccatggaccttggtgaactgtgtgaagacacaatcacttataactgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacattggattttgaactgataaaaacagaagccaaacatcccgccactctaaggaagtattgtgtagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggatcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacagcccagtcaacatagaagcagaacctccatttggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaagcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcgaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaatatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggccatcttgtgcgtcccaaatgcagtgatattggaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcattagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagagtggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcattgaagacaatccagacattgaagatgacatctttagaaagaaaagattgaccatcatggacctccacccaggagcagggaaaacaaagagataccttccagcaatagtcagagaagctataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagctacccctcctggaagcagagacccatttccccagagcaatgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaagacttttgattctgaatatatcaagactaggaccaatgattgggactttgtggtcacgacagacatttcagaaatgggtgctaacttcaaggctgagagggttatagaccccagacgctgcatgaaaccagtcatattaacggacggtgaagagcgggtgatcttggcaggacccatgccagtgacccattctagtgcagcacaaagaagagggagagtaggaagaaatccaaaaaatgataatgaccagtacatatacatgggggaacctttggaaaatgatgaagactgtgcacattggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgaaagtaacatcctggacatagatctacgtcctgcatcagcttggactctatatgccgtggcaacaactttcatcacaccaatgttgaggcatagcattgaaaactcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggagagaaatggaaaaaccggttgaatgcattggggaagagtgaattccagatctacaagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgacgttttttttactccgccagaaaagtgtgacacattgctgtgtgacataggggagtcgtcaccaaaccccacggttgaggcaggacgaacactcagagttttaaacttagtggaaaattggctgaacaacaacacccaattttgcataaaggttctcaccccatacatgccctcagttatagaaaaaatggaagcactacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaataggaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaaatggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaatgaagatcactggttttccagagagaactccctgagtggagtggaaggagaagggctacacaaactaggctacattttaagggacgtgagtaagaaagaaggaggagcaatgtatgccgatgacaccgcaggatgggacacaagaatcacactagaggacttaaaaaatgaagagatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggaaggagaaggagtcttcaaaagcatccagcaactgacagttaaagaagaaattgcagtggaaaactggttaatgagagtggggcgtgagaggttatcaagaatggccatcagtggagatgattgtgttgtgaaacccttagatgacaggtttgcaagtgctctaacagctctaaatgacatgggaaaagttaggaaagacatacaacaatgggaaccttcaagaggatggaacgattggacacaagtgcccttttgttcacaccatttccatgagttaatcatgaaggatggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagagtcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7091 - RNA, 9876 nt, synthetic construct
  misc_feature 1..9876: note = derived and/or modified CDS sequence (wt) from DENV-2__EU359009__SS-prME
  source 1..9876: mol_type = other RNA
actgcaggtataattattatgatgatcccaacagtgatggcgttccatttaaccacacgcaatggagaaccacacatgatcgtcagtagacaagagaaagggaaaagtcttctgtttaaaacagagaacggtgtgaacatgtgcaccctcatggccatggaccttggtgaactgtgtgaagacacaatcacttacaattgtcctcttctcaggcagaatgaaccagaagacatagactgttggtgcaactctacgtctacatgggtaacttatgggacatgcacagctacaggagaacacagaagggaaaaaagatcagtggcactcgttccacatgtgggaatgggactggagacacgaactgaaacatggatgtcatcagaaggggcctggaaacatgcacagagaattgagacctgggtcttgagacatccaggcttcaccataatggcagcaatcctggcatacaccataggaacgacatatttccaaagagtcctgattttcatcttactgacagctatcgctccttcaatgacaatgcgttgtataggaatatcaaatagagactttgtggaaggggtttcaggaggaagctgggttgacatagtcttggaacatggaagctgtgtgacgacgatggcgaaaaataaaccaacattggattttgaactgataaagacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatgggggaatggatgcggattatttggaaagggaggtatcgtgacctgtgcaatgttcacatgcaaaaagaacatggaaggaaaaatcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggactcgacttcaatgagatggtgttgctgcaaatggaaaacaaggcttggctggtgcacaggcaatggttcttagacctgccatttccatggctgcccggagcagacacacaaggatcaaattggatacagaaggagacattggtcactttcaaaaatcctcatgcaaagaaacaggatgttgttgttttaggatcccaagaaggggctatgcacacagcactcacaggggccacggaaatccagatgtcatcaggaaacttactattcacaggacatcttaaatgtaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaattgtcacagaaaaagacagcccagtcaacatagaagcagaacctccattcggagacagctatatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaattctcataggagtcgtcatcacatggataggaatgaattcacgcagcacctcactgtctgtgtcactagtattagtgggagtcgtgacattgtatttgggagttatggtgcaggccgatagtggttgcgttgtgagctggaaaaacaaagaactgaaatgtggcagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaactgaatcacattctatcagaaaatgaggtgaagttgaccatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcactagaggttgaagattatggctttggagtattcaccactaacatatggctgaaattgaaagaaaggcaggatgtattttgtgactcaaaactcatgtcagcagccataaaagacaacagagccgtccacgccgacatgggttattggatagaaagcgcactaaatgacacatggaagattgagaaagcctcttttattgaagttaaaagctgccactggccaaagtcacacactctctggagcaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaactacagtggtggtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgcttagaacccgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaggtcagaccaacttttgcagctggactactcttaagaaagctgacctccaaggaattgatgatgaccaccataggaatcgtactcctctctcagagcaccataccagagactatacttgaactgactgacgcgttggctttggggatgatggttctcaaaatagtaagaaacatggaaaagtatcaactagcagtgactatcatggctatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgacattcccatgacaggaccactagtggctggagggcttctcactgtgtgttacgtgctcactggaagatcggctgatttggaactggagagagctgctgacgtaagatgggaagaacaggcagagatatcaggaagcagtccaattctgtcgataacaatatcggaagatggtagcatgtcgataaaaaatgaagaagaagaacaaacactgaccatactgattagaacaggactgctggtgatatcaggactgtttcccgtgtcaataccaatcacggcagctgcatggtacctgtgggaagtgaaaaagcaacgagccggagtattgtgggatgtcccttcacctccacctgtgggaaaggccgaactggaagatggagcctatagaatcaagcagaaagggattctaggatactcgcagataggagccggagtctacaaagaaggaacattccacacaatgtggcatgtcacacgtggtgctgttctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggcgccgtatctctggacttttctcctggaacgtcaggatctccaattgtcgacaaaaaaggaaaagttgtgggcctttatggcaacggtgtcgtcacaaggagtggaacatatgtgagtgccatagcccagactgaaaaaagcattgaagacaacccagagattgaagatgacatctttcgaaagaaaagattgaccatcatggacctccacccaggagcaggaaaaacaaagagatatcttccagcaatagtcagagaagccataaaacgaggcttgagaacactaatcctggcccccactagagttgtggcggctgaaatggaagaagctctcagaggacttccaataagataccaaaccccagctatcagagctgagcacactggacgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccatttcctcagagcaacgcaccaatcatggatgaagaaagggaaatccctgagcgttcgtggaactcaggacatgagtgggttacggattttaaagggaagactgtttggtttgttccaagtataaaagcaggaaatgatatagcagcttgcctgagaaagaatggaaagaaagtgatacaactcagcaggaagacttttgatactgaatatatcaagactaggaccaatgattgggactttgtggtcacgacagacatttcagaaatgggtgctaacttcaaggctgagagggttatagaccccagacgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgcgcacactggaaagaagctaagatgcttctagataacatcaacacgcctgaaggaatcattcccagcatgtttgaaccagagcgtgaaaaggtcgacgccattgatggtgaataccgcttgagaggagaagcgaggaaaacatttgtggacctaatgagaagaggggacctaccagtttggctagcctacagagtggcagctgaaggtatcaactacgcagacagaagatggtgctttgatggagtcaagaacaaccaaatcttggaagaaaatgtggaagtggaaatttggacaaaagaaggagaaaggaagaaattaaaacccagatggttagatgctaggatctactctgacccactggcgctcaaagaatttaaggaattcgcagctggaagaaaatccctgaccctgaatctaatcaccgagatgggtaggctcccaaccttcatgacccagaaagcaaggaatgcattggacaacttagcagtcctacatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacagccagtattctcctatggtatgcacaaatacagccacattggatagcagcttcaataatactggagttttttctcatagtcttgctcattccagagccagaaaagcagagaacaccccaagataaccaattaacttatgttgtcatagccatccttacagtggtggccgcaaccatggcaaacgagatgggtttcctggaaaaaacaaagaaagatttcggattgggaagcattacaacccagcaacctgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcgaaaatggacatcggagttccccttctcgctattggatgctattcacaagtcaaccccataaccctcacagcagcccttctcttattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcgaccgggcccatctctacactgtgggaaggaaatccagggagattttggaacacaactattgcagtgtcaatggctaacatttttagagggagttacctggccggagccggacttctcttttctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaactttagcaaaagaaggcatcaagagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgtctccaaagtggagtcgatgtcttttttactccgccagaaaagtgtgacacattgctgtgtgacataggggagtcgtcaccaaaccccacggttgaggcaggacgaacactcagagttctaaacttagtggaaaactggctgaacaacaacacccaattttgcataaaggttcttaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaggccacatacgagccggatgttgatctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccaaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggcttggagcacgcttcttagagtttgaagccctaggtttcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggatttgaaaaatgaagaaatggtgacaaaccacatggaaggagaacacaagaaacttgctgaagccattttcagattaacgtaccaaaacaaagtggtgcgtgtgcaaagaccgacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcatctgacagtcacagaagaaattgcagtgaaaaactggttagtaagagtggggcgtgagaggttatcaagaatggccatcagcggagacgattgtgttgtgaaacccttagatgacaggtttgcaagcgctctaacagctctaaatgacatgggaaaggtcaggaaagacatacaacaatgggaaccttcaagaggatggaacgattggacacaagtgcccttttgttcacaccatttccatgagttaatcatgaaggacggtcgtgtacttgtggttccatgtagaaaccaagatgaactgattggtagggcccgaatttcccagggagccgggtggtccttgcgggaaacagcctgtttggggaagtcttacgcccaaatgtggagcctaatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggatccaagaaaacccatggatggaagacaaaactccagtagaatcatgggaggaaatcccatatttggggaagagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 7092 - RNA, 9876 nt, synthetic construct
  misc_feature 1..9876: note = derived and/or modified CDS sequence (wt) from DENV-2__KC131142__SS-prME
  source 1..9876: mol_type = other RNA
actgcaggtataattattatggtgatcccaacagtgatggcgttccatttaaccacacgcaatggagaaccacacatgatcgtcagtagacaagagaaagggaaaagtcttctatttaaaacagagaacggtttgaacatgtgcaccctcatggccatggaccttggtgaactgtgtgaagacacaatcacttacaattgtcctcttctcaggcagaatgaaccagaagacatagactgttggtgcaactctacgtctacatgggtaacttatgggacatgcacagctacaggagaacacagaagggaaaaaagatcagtggcactcgttccacatgtgggaatgggactggagacacgaactgaaacatggatgtcatcagaaggggcctggaaacatgcacagagaattgagacctgggtcttgagacatccaggcttcaccataatggcagcaatcctggcatacaccataggaacgacatatttccaaagagtcctgattttcatcttactgacagctatcgctccttcaatgacaatgcgttgtataggaatatcaaatagagactttgtggaaggggtttcaggaggaagctgggttgacatagtcttggaacatggaagctgtgtgacgacgatggcgaaaaataaaccaacattggattttgaactgataaagacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatgggggaatggatgcggattatttggaaagggaggtatcgtgacctgtgcaatgttcacatgcaaaaagaacatggaaggaaaaatcgtgcaaccagaaaacttggagtacaccattgtgataacacctcactcaggggaagagaatgcagtcggaaatgacacaggaaaacacggcaaggaaattaaagtaactccacagagttccatcacagaagcagaactaacaggctatggcactgttacgatggaatgctctccgagaacgggactcgacttcaatgagatggtgttgctgcaaatggaaaacaaggcttggctggtgcacaggcaatggttcttagacctgccattaccatggctgcccggagcagacacacaaggatcaaattggatacagaaggagacattggtcactttcaaaaatccccatgcaaagaaacaggatgttgttgttttaggatcccaagaaggagctatgcacacagcactcacaggggccacggaaatccagatgtcatcaggaaacttactattcacaggacatcttaaatgtaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaattgtcacagaaaaagacagcccagtcaacatagaagcagaacctccattcggagatagctatatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaattctcataggagtcgtcatcacatggataggaatgaattcacgcagcacctcactgtctgtgtcactagtattagtgggagtcgtgacattgtatttgggagttatggtgcaggccgatagtggttgcgttgtgagctggaaaaacaaagaactgaaatgtggcagtgggatttttatcacagacaacgtgcacacatggacagaacaatacaaattccaaccagaatccccttcaaagctggcttcagctatccagaaggcccatgaagaaggcatttgtggaatccgctcagtaacaagactggagaatctgatgtggaaacaaataacaccagaactgaatcacattctatcagaaaatgaggtgaagttgaccatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcactagaggttgaagattatggctttggagtattcaccactaacatatggctgaaattgaaagaaaggcaggatgtattttgtgactcaaaactcatgtcagcagccataaaagacaacagagccgtccacgccgacatgggttattggatagaaagcgcactaaatgacacatggaagattgagaaagcctcttttattgaagttaaaagctgccactggccaaagtcacacactctctggagcaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaactacagtggtggtgactgaggactgtggaaatagaggaccctctttaagaacaactactgcctctggaaaactcataacagaatggtgctgccgatcttgcacattaccaccgctaaggtacagaggtgaggatggatgctggtatggaatggaaatcagaccattgaaagagaaagaagagaacttggtcaactccttggtcacagccggacatggacagattgacaacttctcactaggagtcttgggaatggcattgttcctggaagagatgcttagaacccgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaggtcagaccaacttttgcagctggactactcttaagaaagctgacctccaaggaattgatgatgaccaccataggaatcgtactcctctctcagagcaccataccagagactatacttgaactaactgacgcgttggctttggggatgatggttctcaaaatagtaagaaacatggaaaagtatcaactagcagtgactatcatggctatcttgtgcgtcccaaatgcagtgatattacaaaacgcatggaaagtgagctgcacaacattggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaacgaggctattatggcagtcgggatggtgagcattttagccagttctctcttaaagaatgacattcccatgacaggaccactagtggctggagggcttctcactgtgtgttacgtgctcactggaagatcggctgatttggaactggagagagctgctgacgtaagatgggaagaacaggcagagatatcaggaagcagtccaattctgtcgataacaatatcggaagatggtagcatgtcgataaaaaatgaagaagaagaacagacactgaccatactgattagaacaggactgctggtgatatcaggactgtttcccgtgtcaataccaatcacggcagctgcatggtacctgtgggaagtgaaaaagcaacgagccggagtattgtgggatgtcccttcacctccacctgtgggaaaggccgaactggaagacggagcctatagaatcaagcagaaagggattctaggatactcgcagataggagccggagtctacaaagaaggaacattccacacaatgtggcatgtcacacgtggtgctgttctaatgcataaagggaagagaattgaaccatcatgggcggacgtcaagaaagacctaatatcgtatggaggaggctggaagttagaaggagaatggaaggaaggagaagaagtccaggtcctggcattagagcctggaaagaatccaagagccgtccaaacaaaacccggtctttttaaaactaacactggaaccataggcgccgtatctctggacttttctcctggaacgtcaggatctccaattgtcgacaaaaaaggaaaagttgtgggtctttatggcaacggtgtcgtcacaaggagtggaacatatgtgagtgccatagctcagactgaaaaaagcattgaagacaacctagagattgaagatgacatctttcgaaagaaaagattgaccgtcatggacctccacccaggagcaggaaaaacaaagagatatcttccagcaatagtcagagaagccataaaacgaggcttgagaacactaatcctggcccccactagagttgtggcggctgaaatggaagaagctctcagaggacttccaataagataccaaaccccagctatcagagctgagcatactggacgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccatttcctcagagcaacgcaccaatcatggatgaagaaagggaaatccctgagcgttcgtggaactcaggacatgagtgggttacggattttaaagggaagactgtttggtttgttccaagtataaaagcaggaaatgatatagcagcttgcctgaggaagaatggaaagaaagtgatacaactcagcaggaaaacttttgatactgaatatattaagactaggaccaatgactgggactttgtggtcacgacagacatttcagaaatgggtgctaacttcaaggctgagagggttatagaccccagacgctgcatgaaaccagtcatactaacagacggtgaagagcgggtgatcctggcaggacccatgccagtgacccactctagtgcagcacaaagaagagggagagtaggaagaaacccaaaaaatgaaaatgaccagtacatatacatgggggaacctctggaaaatgatgaagactgcgcacactggaaagaagctaagatgcttctagataacatcaacacgcctgaaggaatcattcccagcatgtttgaaccagagcgtgaaaaggtcgacgccattgatggtgaataccgcttgagaggagaagcgaggaaaacatttgtggacctaatgagaagaggggacctaccagtttggctagcctacagagtggcagctgaaggtatcaactacgcagacagaagatggtgctttgatggagtcaagaacaaccaaatcttggaagaaaatgtggaagtggaaatttggacaaaagaaggagaaaggaagaaattaaaacccagatggttagatgctaggatctactctgacccactggcgctcaaagaattcaaggaattcgcagctggaagaaaatccctgaccctgaatctaatcaccgagatgggtaggctcccaaccttcatgacccagaaagcaaggaatgctttggacaacttagcagtcctacatacggctgaagcaggcggaagggcgtacaatcatgctcttagtgaactgccggagactctggagacattgcttctactgacacttttggccacagtcacgggcggaatcttcctgttcttgatgagcggaaagggtatagggaagatgaccctgggaatgtgctgcataatcacagccagtattctcctatggtatgcacaaatacagccacattggatagcagcttcaataatactggagttttttctcatagtcttgctcattccagagccagaaaagcagagaacaccccaagataaccaattaacttatgttgtcatagccatccttacagtggtggccgcaaccatggcaaacgagatgggtttcctggaaaaaacaaagaaagatttcggattgggaagcattacaacccagcaacctgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcgaaaatggacatcggagttccccttcttgctattggatgctattcacaagtcaaccccataaccctcacagcagcccttctcttattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaactttagcgaccgggcccatctctacactgtgggaaggaaatccagggagattttggaacacaactattgcagtgtcaatggccaacatttttagagggagttacctggccggagccggacttctcttttctatcatgaagaacacggccaacacaagaaggggaactggcaacacaggagagacgcttggagagaaatggaaaaaccggttgaacgcactggggaagagtgaattccagatctataagaaaagtggaatccaggaagtggatagaactttagcaaaagaaggcatcaagagaggagaaacggaccatcacgctgtgtcgcgaggctcagcgaaactgagatggttcgtcgagagaaacctggtcacaccagaagggaaagtagtggaccttggctgcggtagggggggctggtcatactattgtgggggactaaagaatgtaaaagaagtcaaaggcctaacaaaaggaggaccaggacacgaagaacccattcccatgtcaacatatggttggaatctggtgcgtctccaaagtggagtcgatgtcttttttactccgccagaaaagtgtgacacattgctgtgtgacataggggagtcgtcaccaaaccccacggttgaggcaggacgaacactcagagttctaaacttagtggaaaactggctgaacaacaacacccaattttgcataaaggttcttaacccatatatgccttcagttatagaaaaaatggaagcgctacaaaggaaatacggaggagctttagtgaggaatccactctcacgaaattccacacacgagatgtactgggtatccaatgcttccgggaacatagtgtcatcagtgaacatgatttcaagaatgttgattaacagattcacaatgagacacaagaaggccacatacgagccggatgttgatctcggaagtggaacccgtaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaagctgctaacaaaaccttgggacgtcatccctatggtgacacagatggcaatgacagacacgactccatttggacaacagcgcgttttcaaagagaaagtggacacgagaacccaagaaccaaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtggggctgttgaagacagtggattctgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggcttggagcacgcttcttagagtttgaagccctaggtttcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggatttgaaaaatgaagaaatggtgacaaaccacatggaaggagtacacaagaaacttgctgaagccattttcagattaacgtaccaaaacaaagtggtgcgtgtgcaaagaccgacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcatctgacagtcacagaagaaattgcagtgaaaaactggttagtaagagtggggcgtgagaggttatcaagaatggccatcagcggagacgattgtgttgtgaaacccttagatgacaggtttgcaagcgctctaacagctctaaatgacatgggaaaggtcaggaaagacatacaacaatgggaaccttcaagaggatggaacgattggacacaagtgcccttttgttcacaccatttccatgagttaatcatgaaagacggtcgtgtacttgtggttccatgtagaaaccaagatgaactgattggtagggcccgaatttcccagggagccgggtggtctttgcgggaaacagcctgtttggggaagtcttacgcccaaatgtggagcctaatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagagtgtggatccaagaaaacccatggatggaagacaaaactccagtagaatcatgggaggaaatcccatatttggggaagagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 7093 - RNA, 9876 nt, synthetic construct
  misc_feature 1..9876: note = derived and/or modified CDS sequence (wt) from DENV-2__AY858035__SS-prME
  source 1..9876: mol_type = other RNA
acagcaggtataattattatgatgattccaacagtgatggcgttccatttaaccacacgcaacggagaaccacacatgatcgtcagtagacaagagaaggggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggcttcactataatggcagcaatcctggcttacaccataggaacgacatatttccaaagagtcctgatcttcatcttactgacagctgtcgctccctcaatgacaatgcgttgtataggaatatcaaatagagactttgtggaaggggtttcaggaggaagctgggttgacatagtcttggaacatggaagctgtgtgacgacgatggcgaaaaataaaccaacattggattttgaactgataaaaacagaagccaaacaccccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaatcgtgcaaccagaaaacttggaatacaccattgtgataacacctcactcaggggaagagaatgcagtcggaaatgacacaggaaaacacggcaaggaaattaaagtaacaccacagagttccatcacagaagcagaactaacaggctatggcactgttacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcaaagaaacaggatgttgtcgttttaggatcccaagaaggggctatgcacacagcactcacaggggccacggaaatccagatgtcatcaggaaacttactgttcacaggacatcttaagtgcaggctgagaatggacaaactacagctcaaaggaatgtcatattccatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcctgattacagtcaacccaattgtcacagaaaaagacagcccagtcaacatagaagcagaacctccattcggggacagctacatcattataggagtagaaccaggacaactgaagctcagctggtttaagaaaggaagttctattggccaaatgtttgagacaacaatgagaggagcgaagagaatggccattttaggtgacacagcttgggattttggatccttgggaggggtgttcacatccataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaactgaatcacattctatcagaaaatgaggtaaagctgactatcatgacaggagacattaaaggaatcatgcaggcaggaaaacgatccctgcggcctcaacccactgagctgaagtactcttggaaaacatggggcaaagcgaaaatgctctccacagaactccataaccacacctttctcattgatggccccgaaacagcagaatgtcccaacacaaacagagcttggaactcactagaagttgaagactatggctttggagtattcaccaccaacatatggctgaaattgaaagaaaggcaggatgtattttgtgactcaaaactcatgtcagcagccataaaagacaacagagccgtccacgccgatatgggttattggatagaaagcgcactcaatgacacatggaagattgagaaagcctcttttattgaagttaaaagctgccactggccaaagtcacacactctctggagtaatggagtgctagaaagtgagatgataattccaaagaatttcgcaggaccagtgtcacaacacaattacagaccaggctatcatacacaaacggcaggaccctggcatctaggcaggcttgagatggactttgatttctgcgaaggaaccacagtggtggtgactgaggactgtggaaatagaggaccctctttaagaacaactactgcttctggaaaactcataacagagtggtgctgccgatcttgcacattaccaccgctaaggtacagaggtgaggatggatgctggtatggaatggaaattagaccattgaaagagaaagaagagaacttggtcaactctttggtcacagccggacatggacagattgacaacttctcactaggagtcttgggaatggcactgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaactgatgatgaccaccataggaatcgtgctcctctcccagagcaccataccagagactatacttgaactgactgacgcgttggctttggggatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcattgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggagagagctgctgacgtaagatgggaagaacaggcagagatatcaggaagtagtccaattctgtcgataacaatatcggaagatggtagcatgtcgataaaaaatgaagaagaagaacaaacactgaccatactcatcagaacaggactgttggtggtatcaggactctttcccgtgtcaataccaatcacggcagctgcatggtacctgtgggaagtgaaaaaacaacgagcaggagtattgtgggatgtcccttcacccccacctgtgggaaaagccgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagatctaatatcgtatggaggaggctggaagctagaaggagaatggaaggaaggagaagaagtccaggtcctggcattagagcccggaaaaaatccaagagccgtccaaacaaaacccggtctttttaaaactaacactggaaccataggcgccgtgtctctggacttttctcctggaacgtcaggatctccaatcgtcgacaaaaaaggaaaagttgtgggcctttatggcaacggtgtcgttacaaggagtggaacatatgtgagtgctatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccatttcctcagagcaatgcaccaatcatggatgaagaaagggaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaagacttttgattctgaatatattaagactaggaccaatgattgggactttgtggtcacgacagacatttcagaaatgggtgcaaacttcaaggctgagagggtcatagaccccagacgctgtatgaaaccagtcatattaacagacggtgaagagcgggtgatcttggcaggacccatgccagtgacccactctagtgcagcacaaagaagagggagagtaggaagaaatccaaaaaatgaaaatgaccagtacatatacatgggagaacctctggaaaatgatgaagactgtgcacactggaaagaagctaaaatgcttctagacaacatcaacacgcctgaaggaatcattcccagcatgttcgaaccagagcgtgaaaaggtggatgccattgatggtgaataccgcttgagaggagaagcgaggaaaacttttgtggacctaatgagaagaggagacctaccagtctggttagcctacaaagtggcagctgaaggtatcaactacgcagacagaagatggtgctttgatggagtcaagaacaaccaaatcttggaagaaaatgtggaagtggaaatttggacaaaagaaggagaaaggaagaaattaaaacctagatggttggatgctaggatctactctgacccactggcgctcaaagaattcaaggaattcgcagctggaagaaagtccctgaccctgaatctaatcacagagatgggtaggctcccaaccttcatgacccagaaagcaaggaatgcactggacaacttagcagtcttgcatacagctgaagcaggcggaagggcgtacaatcacgctcttagtgaactgccggagactctggagacattgctcttactgactctcttggccacagtcacgggcggaatcttcctgttcttgatgagcggaaagggtatagggaagatgaccctgggaatgtgctgcataatcacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaagcattacaacccagcaacctgagagcaacatcctggacatagatctacgtcctgcatcagcttggactctatatgccgtggcaacaactttcatcacaccaatgttgagacatagcattgaaaattcttcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcacagcagcccttctcttactggtagcacattatgctatcatagggccaggactccaagcgaaagcaactagagaagctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccaggaagattctggaatacaactattgcagtgtcaatggctaacatttttagagggagttacctggccggagccggacttctcttttctatcatgaagaacacggccaacacaagaaggggaactggcaacacaggagagacgcttggagagaaatggaaaaaccggttgaatacattggggaagagtgaattccagatctataagaaaagtggaatccaggaagtggatagaaccttagcaaaagaaggcatcaaaagaggagaaacagaccatcacgctgtgtcgcgaggctcggcgaaactgagatggttcgtcgagagaaacctggtcacaccagaagggaaagtagtggaccttggttgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacacattgctatgtgacataggggagtcgtcaccaaaccccacggttgaagcaggacgaacactcagagttctaaacttagtggaaaattggctgaacaacaacacccaattttgcataaaggttctcaacccatatatgccctcagttatagaaaaaatggaagcgctacaaaggaaatacggaggagctttggtgaggaatccactctcacgaaattccacacacgagatgtactgggtatccaatgcctccgggaacatagtgtcatcagtgaacatgatttcaagaatgttgattaacagattcacaatgagacacaagaaggccacatacgagccagatgttgacctcggaagtggaacccgcaacatcggaattgaaagtgagataccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacgtaggatgtgcaccagagaagaattcacaagaaaggtgagaagtaatgcagccttaggcgccatattcactgatgagaacaagtggaagtcggcacgtgaggctgttgaagacagtggattttgggaattggttgacaaggaaaggaatctccatcttgaaggaaagtgtgagacatgtgtatataacatgatgggaaagagagagaagaagctaggggagttcggcaaagcgaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactggaggacttaaaaaatgaagaaatggtgacaaaccacatggaaggagaacacaagaaacttgctgaagccatcttcaaattaacgtaccaaaacaaggtggtgcgtgtgcaaagaccaacaccaagaggcacagtaatggacatcatatcgagaagagaccaaagaggtagcggacaagtcgtcacctacggcctcaatactttcaccaacatggaagcccaactgatcagacagatggagggagaaggagtcttcaaaagcatccagcaactgacagtcacagaagaaattgcagtgaaaaactggctagaaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcctttttgttcacaccatttccatgagttaatcatgaaggacggtcgtgtactcgtagttccatgcagaaatcaagatgaactgattggtagggcccgaatttcccagggagccgggtggtccttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaagaggaagaggcaggagtcttgtggtag

SEQ ID NO: 7094 - RNA, 9873 nt, synthetic construct
  misc_feature 1..9873: note = derived and/or modified CDS sequence (wt) from DENV-2__JX567951__SS-prME
  source 1..9873: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagctatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcgcccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatatgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgatccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggagattttggaacaccaccattgcagtgtcaatggctaacatctttagggggagctacttggccggagctggacttctcttttccatcatgaagaacacgacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagctcgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacataagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcccttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtgg

SEQ ID NO: 7095 - RNA, 9873 nt, synthetic construct
  misc_feature 1..9873: note = derived and/or modified CDS sequence (wt) from DENV-2__JX567950__SS-prME
  source 1..9873: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgctgccagaaaatctggaatacaccatcgtgataacacctcactcaggagaagagcacgctgtaggtaatgacacaggaaaacatggcgaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttgccatggctgcccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacaggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagtaaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaagactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgccaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcattgacgataaaaggtctcaacccaacagccatttttttaacaactctttcgagaaccagcaagaaaaggagctggccgctaaatgaagctatcatggcagtcgggatggtgagcattttggccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcagtaacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttccccccccccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaaaaggattgaaccatcatgggcagatgtcaagaaagatctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgagagatcgtggacctaatgtgtcatgccacatttactatgaggctgctatcaccagtcagagtgccaaattacaacctgattatcatggacgaagctcacttctcagacccagcaagcatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatattaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcacacggctgaggtaggtggaaaggcgtacactcatgctctcaatgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaatacctcggattgggaagcattacaacccaggaatctgagagcaacatcctggacatagatctacgtcctgcatcagcatggacgctgtatgccgtggctacaacatttgtcacaccaatgttgcgacatagcattgtaaattcctcagtaaatgtcacattaacagccattgctaaccaagctacagtgctaatgggtcttgggaaaggatggccattgtcaaagatggacatcggagttcccctccttgccattggatgctactcacaagtcaaccctataactctcacagctgctcttcttttattggtagcccattatgccattatagggccaggccttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggtaacgtaggagagacacttggagaaaaatggaaaagccgattaaatgcactggggaaaaatgaatttcagatctacaagaaaagtggaatccaggaagtggatagaaccttggcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgtcttcttcaccccgccagaaaagtgtgacacattgttgtgtgacataggggagtcgtcaccaaatcccacgatagaagcaggacgaacactcagagtccttaacttagcggaaaattggttgaacaacaacacccaattttgcataaaggttctcaacccatatatgccctcagtcatagaaaaaatggaaacactacaaaggaaatatggaggagctttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctagaatgtgcaccagagaagaattcacaaggaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagagtttgaagccctaggattcttgaatgaagatcactggttctccagagagaactccctgagtggagtggaaggagaagggctgcacaggctaggctacattttaagagatgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagcgggcaggtcggtacctatggccttaatactttcaccaacatggaagcccaattaattagacagatggaaggagaaggaatcttcaaaagcattcagcacctgacagccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcaggttggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccgtggatggaagacaaaactccagtggaatcatgggaagaaatcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtgg

SEQ ID NO: 7096 - RNA, 9873 nt, synthetic construct
  misc_feature 1..9873: note = derived and/or modified CDS sequence (wt) from DENV-2__HQ012538__SS-prME
  source 1..9873: mol_type = other RNA
acagcaggcgtgattattatgttgattccaacagcaatggcgttccatttaaccacacgtaatggagaaccacacatgatcgttggtaggcaagagaaagggaaaagtcttctgtttaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttgccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcgaggaaatcaaaataacaccacagagttccatcacagaagcagaactgacaggctatggcactgtcacgatggagtgctctccgagaacgggcctcgacttcaatgagatggtgctgctgcagatggaagagaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccatattaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaacaaagaattgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacatcctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgttggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccatacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagtcgcagtatcttttgtgacattgattactgggaacatgtcctttagagacctgggaagagtgatggttatggtgggcgttaccatgacggatgacataggtatgggagtgacttaccttgccctactagcagctttcaaagttagaccaactttcgcagctggactactcttgagaaaactgacctccaaggaattaatgatggccaccataggaatcgcactcctttcccaaagcaccataccagaaaccattcttgaactgactgatgcgttagccttgggcatgatggtcctcaaaatagtgagaaatatggaaaagtaccaattggcagtgaccatcatggctatctcgtgtgtcccaaatgcagtgatactgctaaacgcatggaaggtgagttgcacaatattggcagcggtgtccgtttctccattgctcttaacatcctcacagcagaaaacggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaattacggcagcagcatggtacctgtgggaagtgaagaaacaacgggctggagtattgtgggacgtcccttcacccccaccagtggaaaaagccgaactggaagatggagcctatagaatcaagcaaagagggattcttggatattctcagattggagccggagtttacaaagaaggaacattccatacaatgtggcacgtcacacgtggtgctgttctgatgcatagagggaaaaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagatccagcaagtatagcagctagaggatatatttcaactcgagtagaaatgggtgaagcagctgggattttcatgacagccactcctccgggaagtagagacccatttcctcagagcaatgcaccaatcatggatgaggaaagagaaatccctgagcgctcgtggaattcaggacatgaatgggtcacggattttaaagggaagactgtttggtttgttccaagtataaaagcaggaaatgacatagcagcttgtcttagaaaaaacggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagtcatactaacagatggcgaagagcgggtgatcttggcaggacctatgccagtgacccactctagtgcagcacaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttggcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgtcttcttcaccccgccagaaaagtgtgatacattgttgtgtgacataggggagtcgtcaccaaatcccacgatagaagcaggacggacactcagagtcctcaacttagtggaaaattggttgaacaacaacacccaattttgcataaaggttctcaacccatatatgccctcagtcatagaaaaaatggaaacactacaaaggaaatatggaggagccttagtgaggaatccactctcacgaaactccacacacgagatgtactgggtatccaatgctaccgggaatatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggtagctatgaaacaaaacaaactggatcagcatcatctatggtgaacggagtggtcagactgctgacaaaaccttgggacgtcgtccctatggtgacacagatggcaatgacagacacgactccatttggacaacaacgcgtcttcaaagagaaagtggacacgagaacccaagaaccgaaggaaggcacaaagaaactgatgagaattacggcagagtggctttggaaagaactaggaaagaaaaagacacctaggatgtgtaccagagaagaattcacaagaaaggtgagaagcaatgcagccttgggggccatattcactgatgaaaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagcgggcaagtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagatatacaacaatgggaaccttcaagaggatggaacgactggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagccgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtgg

SEQ ID NO: 7097 - RNA, 9873 nt, synthetic construct
  misc_feature 1..9873: note = derived and/or modified CDS sequence (wt) from DENV-2__HQ012533__SS-prME
  source 1..9873: mol_type = other RNA
acagcaggcgtgattattatgttgattccaacagcaatggcgttccatttaaccacacgtaatggagaaccacacatgattgttggtaggcaagagaaagggaaaagtcttctgtttaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttgccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcgaggaaatcaaaataacaccacagagttccatcacagaagcagaactgacaggctatggcactgtcacgatggagtgctctccgagaacgggcctcgacttcaatgagatggtgctgctgcagatggaagagaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgtaggctgagaatggacaaactacagctcaaaggaatgtcatactctatgtgtacaggaaagtttaagattgtgaaggaaatagcagaaacacaacatggaacaatagttatcagagtacaatatgaaggggacggctccccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaacttaattggtttaagaagggaagttccatcggccaaatgtttgagacaacaatgagaggagcgaagagaatggccatattaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaacaaagaattgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacatcctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgttggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccatacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagtcgcagtatcttttgtgacattgattactgggaacatgtcctttagagacctgggaagagtgatggttatggtgggcgttaccatgacggatgacataggtatgggagtgacttaccttgccctactagcagctttcaaagttagaccaactttcgcagctggactactcttgagaaaactgacctccaaggaattaatgatggccaccataggaatcgcactcctttcccaaagcaccataccagaaaccattcttgaactgactgatgcgttagccttgggcatgatggtcctcaaaatagtgagaaatatggaaaagtaccaattggcagtgaccatcatggctatctcgtgtgtcccaaatgcagtgatactgctaaacgcatggaaggtgagttgcacaatattggcagcggtgtccgtttctccattgctcttaacatcctcacagcagaaaacggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggatccttggatattctcagattggagccggagtttacaaagaaggaacattccatacaatgtggcacgtcacacgtggtgctgttctgatgcatagagggaaaaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagatccagcaagtatagcagctagaggatatatttcaactcgagtagaaatgggtgaagcagctgggattttcatgacagccactcctccgggaagtagagacccatttcctcagagcaatgcaccaatcatggatgaggaaagagaaatccctgagcgctcgtggaattcaggacatgaatgggtcacggattttaaagggaagactgtttggtttgttccaagtataaaagcaggaaatgacatagcagcttgtcttagaaaaaacggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagtcatactaacagatggcgaagagcgggtgatcttggcaggacctatgccagtgacccactctagtgcagcacaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgactctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgtagtcatagccatcctcacagtggtggccgcaaccatggcaaatgagatgggcttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttggcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgtcttcttcaccccgccagaaaagtgtgatacattgttgtgtgacataggggagtcgtcaccaaatcccacgatagaagcaggacggacactcagagtcctcaacttagtggaaaattggttgaacaacaacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggtagctatgaaacaaaacaaactggatcagcatcatctatggtgaacggagtggtcagactgctgacaaaaccttgggacgtcgtccctatggtgacacagatggcaatgacagacacgactccatttggacaacaacgcgtcttcaaagagaaagtggacacgagaacccaagaaccgaaggaaggcacaaagaaactgatgagaattacggcagagtggctttggaaagaactaggaaagaaaaagacacctaggatgtgtaccagagaagaattcacaagaaaggtgagaagcaatgcagccttgggggccatattcactgatgaaaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacataccaaaacaaggtggtgcgtgtgcaaagaccaacaccaagaggcacagtaatggatatcatatcgagaagagaccaaagaggcagcgggcaagtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagatatacaacaatgggaaccttcaagaggatggaacgactggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtgg

SEQ ID NO: 7098 - RNA, 9873 nt, synthetic construct
  misc_feature 1..9873: note = derived and/or modified CDS sequence (wt) from DENV-2__HQ012534__SS-prME
  source 1..9873: mol_type = other RNA
acagcaggcgtgattattatgttgattccaacagcaatggcgttccatttaaccacacgtaatggagaaccacacatgatcgttggtaggcaagagaaagggaaaagtcttctgtttaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacacgttcagagaattgaaacctggatcttgagacatccaggctttgccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcgaggaaatcaaaataacaccacagagttccatcacagaagcagaactgacaggctatggcactgtcacgatggagtgctctccgagaacgggcctcgacttcaatgagatggtgctgctgcagatggaagagaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccatattaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaacaaagaattgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacatcctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgttggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagcgagatgataattccaaaaaattttgccgggccagtgtcacaacacaactacagaccaggctaccatacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagtcgcagtatcttttgtgacattgattactgggaacatgtcctttagagacctgggaagagtgatggttatgttgggcgttcccatgacggatgacataggtatgggagtgacttaccttgccctactagcagctttcaaagttagaccaactttcgcagctggactactcttgagaaaactgacctccaaggaattaatgatggccaccataggaatcgcactcctttcccaaagcaccataccagaaaccattcttgaactgactgatgcgttagccttgggcatgatggtcctcaaaatagtgagaaatatggaaaagtaccaattggcagtgaccatcatggctatctcgtgtgtcccaaatgcagtgatactgctaaacgcatggaaggtgagttgcacaatattggcagcggtgtccgtttctccattgctcttaacatcctcacagcagaaaacggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggctcctcactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagctggagtttacaaagaaggaacattccatacaatgtggcacgtcacacgtggtgctgttctgatgcatagagggaaaagaattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcttggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagatccagcaagtatagcagctagaggatatatttcaactcgagtagaaatgggtgaagcagctgggattttcatgacagccactcctccgggaagtagagacccatttcctcagagcaatgcaccaatcatggatgaggaaagagaaatccctgagcgctcgtggaattcaggacatgaatgggtcacggattttaaagggaagacagtttggtttgttccaagtataaaagcaggaaatgacatagcagcttgtcttagaaaaaacggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagtcatactaacagatggcgaagagcgggtgatcttggcaggacctatgccagtgacccactctagtgcagcacaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttggcaaaagaaggcatcaaaagaggagaaacagaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgtcttcttcaccccgccagaaaagtgtgatacattgttgtgtgacataggggagtcgtcaccaaatcccacgatagaagcaggacggacactcagagtcctcaacttagtggaaaattggttgaacaacaacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggtagctatgaaacaaaacaaactggatcagcatcatctatggtgaacggagtggtcagactgctgacaaaaccttgggacgtcgtccctatggtgacacagatggcaatgacagacacgactccatttggacaacaacgcgtcttcaaagagaaagtggacacgagaacccaagaaccgaaggaaggcacaaagaaactgatgagaattacggcagagtggctttggaaagaactaggaaagaaaaagacacctaggatgtgtaccagagaagaattcacaagaaaggtgagaagcaatgcagccttgggggccatattcactgatgaaaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagcgggcaagtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagatatacaacaatgggaaccttcaagaggatggaacgactggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtgg

SEQ ID NO: 7099 - RNA, 9873 nt, synthetic construct
  misc_feature 1..9873: note = derived and/or modified CDS sequence (wt) from DENV-2__HQ012535__SS-prME
  source 1..9873: mol_type = other RNA
acagcaggcgtgattattatgttgattccaacagcaatggcgttccatttaaccacacgtaatggagaaccacacatgatcgttggtaggcaagagaaagggaaaagtcttctgtttaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttgccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactttaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcgaggaaatcaaaataacaccacagagttccatcacagaagcagaactgacaggctatggcactgtcacgatggagtgctctccgagaacgggcctcgacttcaatgagatggtgctgctgcagatggaagagaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggccgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccatattaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagtacctcactgtctgtgtcactagtattggtgggagtcgtgacactgtacctgggagctatggtgcaggctgatagtggttgcgttgtgagctggaaaaacaaagaattgaaatgtggcagcgggatcttcattacagataacgtgcacacgtggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacatcctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgttggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccatacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatacagaggtgaggatggatgctggtacgggatggaaatcagaccattgaaagagaaagaggagaatttggtcaactccttggtcacagccggacatggacagattgacaacttttcactaggagtcttgggaatggcactgttcctggaagaaatgctcaggacccgagtaggaacgaaacatgcaatactgctagtcgcagtatcttttgtgacattgattactgggaacatgtcctttagagacctgggaagagtgatggttatggtgggcgttaccatgacggatgacataggtatgggagtgacttaccttgccctactagcagctttcaaagttagaccaactttcgcagctggactactcttgagaaaactgacctccaaggaattaatgatggccaccataggaatcgcactcctttcccaaagcaccataccagaaaccattcttgaactgactgatgcgttagccctgggcatgatggtcctcaaaatagtgagaaatatggaaaagtaccaattggcagtgaccatcatggctatctcgtgtgtcccaaatgcagtgatactgctaaacgcatggaaggtgagttgcacaatattggcagcggtgtccgtttctccattgctcttaacatcctcacagcagaaaacggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtttttccagtatcgataccaattacggcagcagcatggtacctgtgggaagtgaagaaacaacgggctggagtattgtgggacgtcccttcacccccaccagtggaaaaagccgaactggaagatggagcttatagaatcaagcaaagagggattcttggatattctcagattggagccggagtttacaaagaaggaacattccatacaatgtggcacgtcacacgtggtgctgttctgatgcatagagggaaaaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagatccagcaagtatagcagctagaggatatatttcaactcgagtagaaatgggtgaagcagctgggattttcatgacagccactcctccgggaagtagagacccatttcctcagagcaatgcaccaatcatggatgaggaaagagaaattcctgagcgctcgtggaattcaggacatgaatgggtcacggattttaaagggaagactgtttggtttgttccaagtataaaagcaggaaatgacatagcagcttgtctcagaaaaaacggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagtcatactaacagatggcgaagagcgggtgattttggcaggacctatgccagtgacccactctagtgcagcacaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacgaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagcgaccgggcccatctccacactgtgggaaggaaatccagggaggttttggaacactactattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttggcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgtcttcttcaccccgccagaaaagtgtgatacattgttgtgtgacataggggagtcgtcaccaaatcccacgatagaagcaggacggacactcagagtcctcaacttagcggaaaattggttgaacaacaacacccaattttgcataaaggttctcaacccatatatgccctcagtcatagaaaaaatggaaacactacaaaggaaatatggaggagctttagtgaggaatccactctcacgaaactccacacatgagatgtactgggtatccaatgctaccgggaacatagtgtcatcagtgaatatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacatgggcttaccatggtagctatgaaacaaaacaaactggatcagcatcatctatggtgaacggagtggtcagactgctgacgaaaccttgggacgtcgtccctatggtgacacagatggcaatgacagacacgactccatttggacaacaacgcgtcttcaaagagaaagtggacacgagaacccaagaaccgaaggaaggcacaaagaaactgatgagaattacggcagagtggctttggaaagaactaggaaagaaaaagacacctaggatgtgtaccagagaagaattcacaagaaaggtgagaagcaatgcagccttgggggccatattcactgatgaaaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagagtttgaagccctaggattcttgaatgaagatcactggttctccagagggaactccctgagtggagtggaaggagaagggctgcacaggctaggctacattttaagagatgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagcgggcaagtcggcacctatggccttaatactttcaccaacatggaagcccaattaattagacagatggaaggagaaggaatcttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagatatacaacaatgggaaccttcaagaggatggaacgactggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgcgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtgg

SEQ ID NO: 7100 - RNA, 9873 nt, synthetic construct
  misc_feature 1..9873: note = derived and/or modified CDS sequence (wt) from DENV-2__HQ012536__SS-prME
  source 1..9873: mol_type = other RNA
acagcaggtgtgattattatgttgattccaacagcaatggcgttccatttaaccacacgtaatggagaaccacacatgatcgttggtaggcaagagaaagggaaaagtcttctgtttaaaacagaggatggtgtcaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttgccataatggcagcaatcctggcatacaccataggaacgacacatttccaaagggccttgattttcatcttactgacagcagtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagagaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacgggggccacagaaatccagatgtcatcgggaaacttactgttcacaggacatctcaagtgtaggctgagattggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggacttggaaaaaagacacgtcttaggtcgcctgattacagttaacccaatcgtaacaggaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccatattaggtgacacagcctgggactttggatccctgggaggagtatttacatctataggaaaggctctccaccaagttttcggagcaatctatggggctgcttttagtggggtctcatggactatgaaaatcctcataggagtcatcatcacatggataggaatgaattcacgtagtacctcactgtctgtgtcactagtattggtgggagtcgtgacactgtacctgggagctatggtgcaggctgatagtggttgcgttgtgagctggaaaaacaaagaattgaaatgtggcagcgggatattcattacagataacgtgcacacatggacagagcaatataagttccaaccagaatccccttcaaaactagcttcagctatccaaaaagctcacgaagagggcatttgtggaatccgctcagtaacaagattggagaatctgatgtggaaacaaataacaccagaattgaatcacatcctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgttggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatggcacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccatacacaaacagcaggaccttggcatctaggtaagcttgagatggacttcgatttctgcgaaggaaccacagtagtggtgactgaggactgtggaaatagaggaccctccttaagaacgaccactgcctctggaaaacttataacagaatggtgctgccgatcttgcacactaccacctctaagatacagaggtgaggatggatgctggtacgggatggaaatcagaccattgaaagagaaagaggagaatttggtaaactccttggtcacagccggacatgggcagattgacaacttttcactaggagtcttgggaatggcactgtttctggaagaaatgctcaggacccgagtaggaacaaaacatgcaatactgctagtcgcagtatcttttgtgacattgattactgggaacatgtcctttaaagacctgggaagagtgatggttatggtgggcgttgccatgacggatgatataggtatgggagtgacttaccttgccctactagcagctttcaaagttagaccaactttcgcagctggactactcttgagaaaactgacctccaaggaattaatgatggccaccataggaatcacactcctttcccaaagcaccataccagaaaccattcttgaactgactgatgcgttagccttgggcatgatggtcctcaaaatagtgagaaatatggaaaagtaccaattggcagtgaccatcatggctatctcgtgtgtcccaaatgcagtgatactgctaaacgcatggaaggtgagttgcacaatattggcagcggtgtccgtctctccattgctcctaacatcctcacagcagaaaacggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaagaatgaagaggaagaacaaacactgaccatactcatcagaacgggattgctggtgatctcaggagtttttccagtatcgataccaattacggcagcagcatggtacctgtgggaagtgaagaaacaacgggctggagtattgtgggacgtcccttcacccccaccagtgggaaaagccgaactggaagatggagcttatagaatcaagcaaagagggattcttggatattctcagattggagccggagtttacaaagaaggaacattccatacaatgtggcacgtcacacgtggtgctgttctgatgcatagagggaaaaggattgaaccatcatgggcagacgtcaagaaagatctaatatcatatggaggaggctggaagctagaaggagaatggaaagaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggtaatggtgtcgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagctcacttcacagatccagcaagtatagcagctagaggatatatttcaactcgagtagaaatgggtgaagcagctgggattttcatgacagccactcctccgggaagtagagacccatttcctcagagcaatgcaccaatcatggatgaggaaagagaaatccctgagcgctcgtggaattcaggacatgaatgggtcacggattttaaagggaagactgtttggtttgttccaagtataaaagcaggaaatgacatagcagcttgtctcagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagtcatactaacagatggcgaagagcgggtgattttggcaggacctatgccagtgacccactctagtgcagcacaaagaagagggagagtaggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgagggtatcaactacgcagacagaaggtggtgttttgatggaatcaagaacaaccaaatactggaagaaaacgtggaagtggagatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagatgcactggacaacttagctgtgctgcatacggctgaggcaggtggaagggcgtataatcatgctctcagtgaactgccggagaccctggagacactgcttttactgacactcctggccacagtcacaggaggaatcttcttattcttaatgagcggaaaaggcatagggaagatgaccctgggaatgtgttgcataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccactgtcaaagatggacatcggagttcccctccttgccattggatgctattcacaggtcaaccctataactctcacagcagctcttcttttattggtagcacattatgccattatagggccaggacttcaagcaaaagcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttggcaaaagaaggcatcaaaagaggagaaacggaccaccacgctgtgtcgcgaggctcagcaaaactgagatggttcgtcgagagaaatatggtcacaccagaagggaaggtggtggaccttggctgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgtcttcttcaccccgccagaaaagtgtgatacattgttgtgtgacataggggagtcgtcaccaaatcccacgatagaagcaggacggacactcagagtcctcaacttagtggaaaattggttgaacaacaacacccaattttgcataaaagttctcaacccatatatgccttcagtcatagaaaaaatggaaacactacaaaggaaatacggaggagctttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaaacaagagcatgaaacatcatggcactatgaccaagaccacccatacaaaacatgggcttaccatggtagctatgaaacaaaacaaactggatcagcatcatctatggtgaacggagtggtcagactgctgacaaaaccttgggacgtcgtccctatggtgacacagatggcaatgacagacacgactccatttggacaacaacgcgtcttcaaagagaaagtggacacgagaacccaagaaccgaaggaaggcacaaagaaactgatgagaattacggcagagtggctttggaaagaactaggaaagaaaaagacacctaggatgtgtaccagagaagaattcacaagaaaggtgagaagcaatgcagccttgggggccatattcactgatgaaaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagcgggcaagtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggccatcagtggagatgattgtgttgtaaaacccttagatgacagatttgcaagtgctttaacagctctaaatgacatgggaaaagttaggaaagatatacaacaatgggaaccttcaagaggatggaacgactggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcacgaatggatgacgacggaagatatgctggcagtctggaatagggtgtggatccaagaaaacccgtggatgggagacaaaactccagtggaatcatgggaagaagtcccatacttggggaaaagagaagaccaatggtgcggctcattgattgggctaacaagcagggctacctgggcaaagaacatccaaacagcaataaatcaagtcagatctcttataggcaatgaggaatacacagactacatgccatccatgaagagattcagaagggaagaggaagaggcaggtgttctgtgg

SEQ ID NO: 7101 - RNA, 9873 nt, synthetic construct
  misc_feature 1..9873: note = derived and/or modified CDS sequence (wt) from DENV-2__HQ012537__SS-prME
  source 1..9873: mol_type = other RNA
acagcaggcgtgattattatgttgattccaacagcaatggcgttccatttgaccacacgtaatggagaaccacacatgatcgttggtaggcaagagaaagggaaaagtcttctgtttaaaacagaggacggtgttaacatgtgtaccctcatggccatagaccttggtgaattgtgtgaagatacaatcacgtacaagtgtcccctcctcaggcaaaatgaaccagaagacatagattgttggtgcaactccacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgtccagagaattgaaacctggatcttgagacatccaggctttgccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactttaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagagaatctggaatacactatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagagaaagcttggctggtgcacaggcaatggttcctagacctgccgttaccatggctacccggagcggacacacaaggatcaaattggatacagaaagagacattggtcactttcaaaaatccccacgcgaagaaacaggacgtcgttgttttaggatctcaagaaggggccatgcacacggcacttacaggggccacagaaatccagatgtcatcaggaaacttactgtttacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggccgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccatattaggcgacacagcctgggattttggatccctgggaggagtgtttacatctataggaaaggctctccaccaagttttcggagcaatctatggggctgcttttagtggggtctcatggactatgaaaatcctcataggagtcatcattacatggataggaatgaattcacgtagtacctcactgtctgtgtcactagtattggtgggagtcgtgacactgtacctgggagctatggtgcaggctgatagtggttgcgttgtgagctggaaaaacaaagaattgaaatgtggcagcgggatcttcattacagataacgtgcacacgtggacagaacaatataagttccaaccagaatccccttcaaaactagcttcagctatccaaaaagctcatgaagagggcatttgtggaatccgctcagtaacaagattggagaatctgatgtggaaacaaataacaccagaattaaatcacatcctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgttggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcacttaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccatacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgtacactaccacctctaagatacagaggtgaggatggatgctggtacgggatggaaatcagaccattgaaagagaaagaggagaatttggtcaactccttggtcacagccggacatggacagattgacaacttttcactaggagtcttgggaatggcactgttcctggaagaaatgctcaggacccgagtaggaacgaaacatgcaatactgctagtcgcagtatcttttgtgacattgattactgggaacatgtcctttagagacctaggaagagtgatggttatggtgggcgttaccatgacggatgacataggtatgggagtgacttaccttgccctactagcagctttcaaagttagaccaactttcgcagctggactactcttgagaaaactgacctccaaggaattaatgatggccaccataggaatcgcactcctttcccaaagcaccataccagaaaccattcttgaactgactgatgcgttagccctgggtatgatggtcctcagaatagtgagaaatatggaaaagtaccaattggcagtgaccatcatggctatctcgtgtgtcccaaatgcagtgatactcctaaacgcatggaaggtgagttgcacaatattggcagcggtgtccgtttctccattgctcttaacatcctcacagcagaaaacggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtttttccagtatcgataccaattacggcagcagcatggtacctgtgggaagtgaagaaacaacgggctggagtattgtgggacgtcccttcacccccaccagtggaaaaggccgaactggaagatggagcttatagaatcaagcaaagagggattcttggatattctcagattggagccggagtttacaaagaaggaacattccatacaatgtggcacgtcacacgtggtgctgttctgatgcatagagggaaaaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcgggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgaacacaccgggcgggagatcgtggacctaatgtgtcatgccacattcactatgaggctgctatcaccagtcagagtgccaaattacaacctgatcatcatggacgaagcccacttcacagatccagcaagtatagcagctagaggatatatttcaactcgagtagaaatgggtgaagcagctgggattttcatgacagccactcctccgggaagcagagacccatttcctcagagcaatgcaccaatcatggatgaggaaagagaaattcctgagcgctcgtggaattcaggacatgaatgggtcacggattttaaagggaagactgtttggtttgttccaagtataaaagcaggaaatgacatagcagcttgtctcagaaaaaacggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagtcatactaacagatggcgaagagcgggtgattttggcaggacctatgccagtgacccactctagtgcagcacaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaatcaagaacaaccaaatactggaagaaaacgtggaagtggaaatctggacgaaagaaggggaaaggaagaaattaaaacccagatggttggatgctaggatctattctgacccactggcactaaaagaattcaaggaatttgcggctggaagaaaatctttgaccctgaacctaatcacagaaatgggtaggcttccaactttcatgactcagaaggcaagagacgcactggacaacttagctgtgctgcatacggctgaggcaggtggaagggcgtacaaacatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagcattctcctatggtatgcacagatacaaccacactggatagcagcttcaataatactggagtttttcctcatagttttgcttattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgttgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtgttaatgatgaggactacatgggctctgtgtgaagctctaaccctagcgaccgggcccatctccacactgtgggaaggaaatccagggaggttttggaacactactattgcagtgtcaatggccaacatctttagggggagctacttggccggagctggacttcttttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttggcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgtcttcttcaccccgccagaaaagtgtgatacattgttgtgtgacataggagagtcgtcaccaaatcccacgatagaagcaggacggacactcagagtcctcaacttagcggaaaattggttgaacaacaacacccaattttgcataaaggttctcaacccatatatgccctcagtcatagaaaaaatggaaacactacaaaggaaatatggaggagctttagtgaggaatccactctcacgaaactccacacatgagatgtactgggtatccaatgctaccgggaacatagtgtcatcagtgaatatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacatgggcttaccacggtagctatgaaacaaaacaaactggatcagcatcatctatggtgaacggagtggtcagactgctgacgaaaccttgggacgtcgtccctatggtgacacagatggcaatgacagacacgactccatttggacaacaacgcgtcttcaaagagaaagtggacacgagaactcaagaaccgaaagagggcacaaagaaactgatgagaattacggcagagtggctttggaaagaactaggaaagaaaaagacacctaggatgtgtaccagagaagaattcacaagaaaggtgagaagcaatgcagccttgggggccatattcactgatgaaaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagagtttgaagccctaggattcttgaatgaagatcactggttctccagagggaactccctgagtggagtggaaggagaagggctgcacaggctaggctacattttaagagatgtgagcaagaaggaagggggagcaatgtacgctgatgatacagcaggatgggacacaagaatcacactagaggacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagcgggcaagtcggcacctatggccttaacactttcaccaacatggaagcccaattaattagacagatggaaggagaaggaatcttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagatatacaacaatgggaaccttcaagaggatggaacgactggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgcgacctcagactggcagcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaaccaagtcagatcccttataggcaatgaggaatacacagactacatgccatccatgaagagattcagaagggaagaggaagaggcaggtgtcctgtgg

SEQ ID NO: 7102 - RNA, 9876 nt, synthetic construct
  misc_feature 1..9876: note = derived and/or modified CDS sequence (wt) from DENV-2__KU365901__SS-prME
  source 1..9876: mol_type = other RNA
actgcaggtataattattatgatgattccaacagtgatggcgttccatttaaccacacgcaacggagaaccacacatgatcgtcagtagacaagagaaagggaaaagtcttctgttcaaaacagagaacggtgtgaacatgtgtaccctcatggccatggaccttggtgaactgtgtgaagacacaatcacttataactgtcctcttctcaggcagaatgaaccagaagacatagactgttggtgcaactccacgtctacatgggtaacttatgggacatgtaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggcttcaccataatggcagcaatcctggcctacactataggaacgacatatttccaaagagtcctgattttcatcttactgacagctgtcgctccttcaatgacaatgcgttgtataggaatatcaaatagagactttgtggaaggggtttcaggaggaagctgggttgacatagtcttggaacatggaagctgtgtgacgacgatggcgaaaaataaaccaacattggattttgaactgattaaaacagaagccaaacaccccgccactctaaggaagtattgtatagaggcaaagctgaccaacacaacaacagcatctcgctgcccaacacaaggagaacctagcctaaatgaagaacaggacaaaagatttgtctgtaaacactccatggtagacagaggatggggaaatggatgcggattatttggaaagggaggtatcgtgacctgtgcaatgttcacatgcaaaaagaacatggaaggaaaaatcgtgcaaccagaaaacttggagtacaccattgtgataacacctcactcaggggaggagaatgcagtcggaaatgacacaggaaaacacggcaaggaaattaaagtaacaccacagagttccatcacagaagcagaactaacaggctatggcaccgtcacgatggagtgctctccgagaacgggcctcgacttcaatgagatggtgttgctgcaaatggaaaacaaggcttggctggtgcacaggcaatggttcttagacctgccattaccatggctgcccggagcagacacacaaggatcaaattggatacagaaggagacattggtcactttcaaaaatccccatgcaaagaaacaggacgttgtcgttttaggatcccaagaaggggctatgcacacagcactcacaggggccacggaaatccagatgtcatcaggaaacttactgttcacaggacatcttaagtgcaggctgagaatggacaaactacagctcaaaggaatgtcatattccatgtgtacaggaaagtttaaagttgtgaaggaaatagcagaaacacaacatggaacaatagtcatcagagtacaatatgaaggggacggttctccgtgtaagatcccttttgaaataatggatttggaaaaaagacatgtcctaggtcgcttgattacagtcaacccaattgtcacagaaaaagacagcccagtcaacatagaagcagaacctccattcggggacagctacatcattataggagtagaaccaggacaactgaagctcagctggtttaaaaaaggaagttctattggccaaatgtttgagacaacaatgagaggagcgaagagaatggccattttaggtgacacagcttgggattttggatccttgggaggggtgttcacatccataggaaaagccctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaggaactgaaatgtggcagtgggatttttatcacagacaatgtacacacatggacagaacaatacaaattccaaccagaatccccttcaaagctggcttcagctatccagaaggctcacgaagaaggcatttgcggaatccgctcagtaacaagactggagaatctgatgtggaaacaaataacacaagaactgaatcacattctatcagaaaatgaggtgaagttgactatcatgacaggagacattaaaggaatcatgcaggcaggaaaacgatccctgcggcctcaacccactgagctgaagtactcttggaaaacatgggggaaagcgaaaatgctctccacagaacttcataaccacacctttctcattgatggccccgaaacagcagaatgtcccaacacaaacagagcttggaactcactagaagttgaagactatggctttggagtattcaccaccaacatatggctgaaattgaaagaaaagcaggatgtattttgtgactcaaaactcatgtcagcagccataaaagacaacagagccgtccacgccgatatgggttattggatagaaagcgcactcaatgacacatggaagattgagaaagcctctttcattgaagttaaaagctgcaactggccaaagtcacacactctctggagtaatggagtgttagaaagtgagatgataattccaaaaaattttgcaggaccagtgtcacaacacaattacagaccaggctatcacacacaaacggcaggaccctggcacctaggcaggcttgagatggactttgaattctgcgaaggaaccacagtggtggtgactgaggactgtggaaatagaggaccctctttaagaacaactactgcttctggaaaactcataacagagtggtgctgccgatcttgcacattaccaccactaaggtacagaggtgaggatggatgctggtatggaatggaaattagaccactgaaagagaaagaagagaacttggtcaactctttagtcacagccggacatggacagattgacaacttctcactgggagtcttgggaatggcactgttcctggaagagatgctcaggacccgagtgggaacgaaacatgcaatattactagttgcagttactttcgtgacattgatcacagggaacatgtcctttcgagatttggggagagtgatggtcatggtgggcgctactatgacggatgacataggcatgggcgtgacttatcttgccctattagcagccttcaaagtcagaccaactttcgcagctggactactcttaagaaagctaacctccaaggaattgatgatggccaccataggaatcgtgctcctctcccagagcaccataccggagaccatacttgaactgactgatgcgttggctttggggatgatggttctcaaaatagtgagaaacatggaaaagtatcaactagcagtgactatcatggccatcttgtgcgtccccaatgcagtgatattacaaaacgcatggagagtgagctgcacaacactggcagtggtgtccgtttccccactgcttttaacatcctcacagcagaaagcggattggataccactggcgttgacgatcaaaggtcttaatccaacagccattttcttaacaaccctctcaagaactagcaagaaaaggagctggccactaaatgaggctattatggcagtcgggatggtgagcattttagccagttccctcctaaagaatgatattcccatgacaggaccattagtggctggagggcttctcactgtgtgttacgtactcactggaagatcggctgatttggaactggaaagagctgctgacgtaagatgggaagaacaggcagagatatcaggaagtagtccaattctgtcgataacaatatcggaagatggtagcatgtcgataaaaaatgaagaagaagaacaaacactgaccatactcatcagaacaggactgttggtgatatcaggactttttcccgtgtcaataccaatcacggcagctgcatggtacctgtgggaagtgaaaaaacaacgagcaggagtattgtgggatgtcccctcacccccacctgtgggaaaggccgaactggaagatggagcatatagaatcaagcagaaagggattctaggatactcgcagatcggagccggagtttacaaagaaggaacattccacacaatgtggcatgtcacacgtggtgctgtcttaatgcataaagggaagagaattgaaccatcatgggcggacgtcaagaaagacctaatatcgtatggaggaggctggaagctagaaggagaatggaaagaaggagaagaagtccaggtcctggcattagagcctggaaagaatccaagagctgtccaaacaaaacccggtctttttaaaactaacactggaaccataggcgccgtgtctctggacttttctcctggaacgtcaggatctccaatcgtcgacaaaaaaggaaaagttgtgggcctttatggcaatggtgttgttacaaggagtggaacatatgtgagtgccatagcccagactgaaaaaagcatcgaagacaatccagagattgaagatgacatctttcgaaagaaaagattaaccatcatggacctccacccaggagcaggaaaaacaaagagataccttccagcaatagtcagagaagccataaaacgaggcctgagaacactaatcctggcccccactagagttgtggcggctgaaatggaagaagctctcagaggacttccaataagataccaaaccccagctatcagagctgagcacactgggcgggagatcgtggatctaatgtgtcatgccacatttaccatgaggctactatcaccaattagagtgccaaattacaacctgattatcatggatgaagcccatttcacagacccagcaagcatagcagccagaggatacatttcaactcgagtagagatgggtgaagcagctgggattttcatgacagctacccctcctggaagcagagacccatttcctcagagcaatgcaccaatcatggatgaagaaagggaaatccctgagcgttcatggaactctggacatgagtgggttacggattttaaagggaaaactgtttggtttgttccaagcataaaagcagggaatgacatagcagcttgcctgagaaagaatggaaagaaagtgatacaactcagcaggaagacttttgattctgaatatattaagactaggaccaatgattgggactttgtggtcacgacagacatttcagaaatgggtgcaaacttcaaggctgagagggttatagaccccagacgctgtatgaaaccagtcatactaacggacggtgaagagcgggtgatcttggcaggacccatgccagtgacccactctagtgcagcacaaagaagagggagagtaggaagaaatccaaaaaatgaaaatgatcagtacatatacatgggggaacctctggaaaatgatgaagactgtgcacactggaaagaagctaaaatgcttctagacaacatcaacacacctgaaggaatcattcccagcatgttcgagccagagcgtgaaaaggtggatgccattgatggtgaataccgcttgagaggagaagcgagaaaaacttttgtggacctaatgagaagaggagacctaccagtctggttagcttacagagtggcagctgaaggtatcaactacgcagacagaagatggtgctttgatggagtcaagaacaaccaaatcttggaagaaaatgtggaagtggaaatttggacaaaagaaggagaaagaaagaaattaaaacccagatggctggatgctaggatctactctgacccactggcgctcaaagaattcaaggaattcgcagctggaagaaagtccctgaccctgaatctaatcacagagatgggtaggctcccaaccttcatgacccagaaagcaaggaatgcactggacaacttagcagtcttgcatacagctgaagcaggcggaagggcgtacaaccatgctcttagtgaactgccggagactctggaaacattgcttttactgacactcttggccacagtcacgggcggaattttcctgttcttgatgagtggaaaaggtatagggaagatgaccctgggaatgtgctgcataatcacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaatgagatgggtttcctggaaaaaacaaagaaagatttcggattgggaagcattacaacccagcaacctgagagcaacatcctggacatagatttacgtcctgcatcagcttggactctgtatgccgtggcaacaactttcatcacaccaatgttgaggcatagcattgaaaattcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcacagcagcccttctcttattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccaggaagattctggaatacaactattgcagtgtcaatggctaacatttttagagggagttacttggccggagccggacttctcttttctattatgaagaacacggccaacacaagaaggggaactggcaacacaggagagacgcttggagaaaaatggaaaaaccggttgaatgcattggggaagagtgaattccagatctataagaaaagtggaatccaggaagtggatagaaccttagcaaaagaaggcatcaaaagaggagaaacagaccaccacgctgtgtcgcgaggctcggcgaaactgagatggttcgtcgagagaaacctggtcacaccagaagggaaagtagtggaccttggttgcggcagggggggctggtcatactattgtgggggactaaagaatgtaaaagaagtcaaaggcctaacaaaaggaggaccaggacacgaagaacccattcccatgtcaacatatggctggaatctggtgcgtcttcaaagtggagttgatgtcttttttactccgccagaaaagtgtgatacattgctgtgtgacataggggagtcgtcaccaaaccccacggttgaagcaggacgaacactcagagttctaaacttagtggaaaattggctgaacaacaacacccaattttgcataaaggttctcaacccatatatgccctcagttatagagaaaatggaagcgctacaaaggaaatacggaggagctttggtgaggaatccactctcacgaaattccacacacgagatgtactgggtatccaatgcttccgggaacatagtgtcatcagtgaatatgatttcaagaatgttgatcaacagattcacaatgagacacaagaaggccacatacgagcccgatgttgacctcggaagtgggacccgcaacatcggaattgaaagtgagacaccaaatttagacataattgggaaaagaatagaaaaaataaaacaagagcatgaaacatcatggcattatgaccaagatcacccatacaaaacgtgggcctaccatggcagctacgaaacaaaacagaccggatcagcatcatccatggtgaacggagtggttaggctgctaacaaaaccttgggacgttatccctatggtgacacagatggcaatgacagatacgactccatttggacaacagcgcgttttcaaagagaaagtggacacgagaacccaagaaccgaaagaaggcacgaaaaaactaatgaaaatcacggcagaatggctctggaaagaactaggaaggaaaaagacacctaggatgtgcaccagagaagaattcacaagaaaggtgagaagtaatgcagccttaggcgccatattcactgatgagaacaagtggaagtcggcacgtgaggctgttgaagacagtggattctgggaattggttgacaaggaaaggaatctccatcttgaaggaaagtgtgagacatgtgtgtataacatgatgggaaagagagagaagaagctaggggagttcggtaaagcgaaaggcagcagagctatatggtacatgtggcttggagcacgcttcttagagtttgaagccctaggattcttgaacgaagatcactggttttccagagagaactccctgagtggagtggaaggagaagggctgcacaaactaggctacattttaagagacgtgagtaagaaagaaggaggagcaatgtacgccgatgacaccgcaggatgggatacaagaatcacattagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacatcatatcgagaagagaccaaagaggtagcggacaggttgtcacctacggcctcaatactttcaccaacatggaagcccaactgatcagacagatggagggagaaggagtcttcaaaagcatccagcaactgacagtcacagaagaaattgcagtgaaaaactggttagcaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcctttttgctcacaccatttccatgagttaatcatgaaggacggtcgtgtactcgtagttccatgcagaaatcaagatgaactgattggtagggcccgaatttcccagggagccgggtggtccttgcgggaaacagcctgtttggggaagtcttacgcccaaatgtggagcctgatgtacttccacagacgtgaccttaggctggcagcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagtcagatccctaataggcaatgaggaatacacagactacatgccatccatgaaaagatttagaagagaagaggaagaggcaggagtcttgtggtag

SEQ ID NO: 7103 - RNA, 9876 nt, synthetic construct
  misc_feature 1..9876: note = derived and/or modified CDS sequence (wt) from DENV-2__GQ398258__SS-prME
  source 1..9876: mol_type = other RNA
actgcaggcatgattatcatgttgattccaacagtgatggcgttccatttaaccacacgcaacggagaaccacacatgatcgtcagtagacaagagaaagggaaaagtcttctgtttaaaacagaggatggtgtgaacatgtgtaccctcatggccatggaccttggtgaattgtgtgaagacacaatcacttataattgtcctctcctcaggcagaatgaaccagaagacatagactgttggtgcaactccacgtccacatgggtaacttatgggacatgcaccgccacaggagaacacagaagggaaaaaagatcagtggcactcgttccacatgtgggaatgggactggagacacgaactgaaacatggatgtcatcagaaggggcctggaaacacgcccagagaattgaaacttggatcttgagacatccaggctttaccataatggcagcaatcttggcatacaccataggaacgacatattttcaaagagtcctgattttcatcttgctgacagctgtcgctccttcaatgacaatgcgttgtataggaatatcaaatagagactttgtggaaggggtttcaggaggaagctgggttgacatagtcttagaacatggaagctgtgtgacgacgatggcaaaaaataaaccaacattggattttgaactgataaaaacagaagccaaacaacccgccactctaaggaagtattgcatagaggcaaagctgaccaatacaacaacagcatctcgctgcccaacacaaggggaacccagcctaaatgaagagcaggacaaaaggttcgtttgcaaacattccatggtagacagaggatggggaaatggatgcggattatttggaaagggaggcatcgtgacctgtgctatgttcacatgcaaaaagaacatggaaggaaaagtcgtgcaaccagaaaacttggaatacaccattgtgataacacctcactcaggggaagagaatgcagttggaaatgacacagggaaacacggcaaggaaatcaaaataacaccacagagttccatcacagaagcagaactgacaggctatggcactgtcacgatggagtgctctccgagaacgggcctcgacttcaatgagatggtgttgctgcaaatggaaaacaaagcttggctggtgcacagacaatggttcctagacctgccgttaccatggctgcccggagcggacacacaaggatcaaattggatacagaaggagacattggtcactttcaaaaatcctcatgcgaagaaacaggatgttgttgttttaggatcccaagaaggggctatgcatacagcacttacaggggccacggaaatccagatgtcatcaggaaacttactgttcacaggacatctcaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccatgcaagatcccttttgagataatggatttggaaaaaagacatgtcttaggtcgcctgattacagtcaacccaatagttacagaaaaagacagcccagtcaacatagaagcagaacctccattcggagacagctacatcattataggagtagaaccgggacaactgaagctcaactggtttaagaaaggaagttctatcggccaaatgtttgagacaacaatgagaggagcgaagagaatggccattttaggtgacacagcctgggattttggatccctgggaggagtgttcacatctataggaaaggctctccaccaagtttttggagcaatttatggggctgccttcagtggggtctcatggactatgaaaatcctcataggagttgtcattacatggataggaatgaattcacgcagcacctcactgtctgtgtcactagtattagtgggagtcgtgacattgtatctgggagttatggtgcaggccgatagtggttgcgttgtgagttggaaaaacaaagaactgaaatgtggcagtgggatttttatcacagacaacgtacacacatggacagaacaatacaaattccaaccagaatctccttcaaagctggcttcagctatccagaaagctcatgaagaaggcatttgtggaatccgctcagtaacaagactggagaatctaatgtggaaacaaataacaccagaactgaatcacattctatcagaaaatgaggtaaagttgactatcatgacaggagacattaaaggaatcatgcaggcaggaaaacgatccttgcggcctcagcccactgagctgaagtattcatggaaaacatggggcaaagcgaaaatgctctccacagagcttcataaccagacctttctcattgatggccccgaaacagcagaatgtcccaacacaaacagagcttggaactcactagaagttgaagactatggctttggagtattcaccaccaacatatggctgaaattgaaagaaaggcaggatgtattttgtgacccaaaactcatgtcagcggccataaaagacaacagagccgtccatgccgatatgggttattggatagaaagcgcacttaatgacacatggaagatagagaaagcctcttttatcgaagttaaaagctgccactggccaaagtcacatactctctggagtaatggagtgctagaaagcgagatgataattccaaagaattttgctggaccagtgtcacaacacaactacagaccaggctatcacacacaaacggcaggaccctggcatctaggtaagcttgagatggactttgatttctgcgaaggaaccacagtggtggtgactgaggactgtgggaatagaggaccctctttaagaacaactaccgcctctggaaaactcataacagaatggtgctgccgatcttgcacattaccaccgctaagatacaaaggtgaggatggatgttggtacgggatggaaatcagaccattgaaagagaaagaagagaacttggtcaactctttggtcacagccggacatggacagattgacaacttctcactaggagtcttgggaatggcattgttcctggaagaaatgctcaggacccgagtaggaacgaaacatgcaatattactagttgcagtttctttcgtgacattgatcacagggaacatgtcctttcgagacctggggagagtgatggttatggtgggtgccactatgacggatgacataggcatgggcgtgacttatcttgccctactagcagccttcaaagttagaccaacttttgcagctggactactcttgagaaagctgacctccaaggaattgatgatgaccaccataggaatcgtactcctctctcagagcaccataccagagactatacttgaactgactgatgcgttggctctggggatgatggtcctcaaaatagtgaaaaatatggaaaaatatcaattagcagtgactatcatggctatcttatgcgtcccaaatgcagtgatattacaaaacgcatggaaagtgagttgcacaatattggcagtggtgtccgtttctccactgctcttaacatcctcacagcagaaagcggattggataccattggcattgacgatcaaaggcctcaatccaacagccattttcttaacaaccctttcaagaactagcaagaaaaggagctggccactaaatgaggctatcatggcagtcgggatggtgagcattttagccagttctctcttaaagaatgatattcccatgacaggaccactagtggctggagggcttctcactgtgtgttacgtgctcactggaagatcggccgatttggaactggagagggccgccgatgtaagatgggaagatcaggcagagatatcaggaagcagtccaattctgtcaataacaatatcggaagatggtagcatgtcgataaaaaatgaagaggaagaacaaacactgaccatactcattagaacaggactgctggtgatatcaggactttttcccgtatcaataccaatcacggcagcagcatggtacctgtgggaagtgaagaaacaacgggctggagtattgtgggatgtcccttcacccccacccgtgggaaaggccgaactggaagatggagcctatagaatcaagcagaaagggattcttggatactcccagatcggagccggagtttacaaagaaggaacattccacacgatgtggcacgttacacgtggtgctgttctaatgcataaagggaagagaattgaaccatcatgggcggacgtcaagaaagacctaatatcgtatggaggaggctggaagctagaaggagaatggaaagaaggagaagaagtccaggtcttggcattagagcctggaaagaatccaagagccgtccaaacaaaacccggtcttttcaaaactaacaccggaaccataggcgctgtatctctggacttttctcctggaacgtcaggatctccaatcgtcgacaaaaaaggaaaagttgtgggtctttatggcaatggtgtcgtcacaaggagtggaacatatgtgagtgccatagcccagactgaaaaaagcattgaagacaatccagagattgaagatgacatctttcgaaagaaaagattgaccattatggacctccacccaggagcgggaaagacgaagagataccttccagcaatagtcagagaggccataaaacgaggcttgagaacattaatcctggcccccactagagttgtggcagctgaaatggaggaagctcttagaggacttccaataagataccaaaccccagccatcagagctgagcacactgggcgggagattgtggatctaatgtgccacgccacatttaccatgaggctgctatcaccagttagagtgccaaattacaacctgatcatcatggatgaagcccatttcacagacccagcaagcatagcagctagaggatacatttcaactcgagtagagatgggtgaagcagctgggattttcatgacagccactcctccgggaagcagagacccatttcctcagagcaatgcaccaatcatggatgaagaaagggaaatccctgaacgttcgtggaattctggacatgagtgggttacggattttaaagggaagactgtttggtttgttccaagtataaaagcaggaaatgatatagcagcttgcctgagaaaaaatggaaagaaagtgatacaactcagtaggaagacctttgattctgaatatatcaagactaggaccaatgattgggacttcgtggtcacgactgacatttcagaaatgggtgctaacttcaaggctgagagggttatagaccccagacgctgcatgaaaccagtcatactaacagacggtgaagagcgggtgatcctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggatgccattgacggtgaataccgcttaagaggagaagcgaggaaaacctttgtggacttaatgagaagaggagacctaccagtctggctggcctacagagtggcagctgaaggtatcaactacgcagacagaaggtggtgttttgatggaatcaagaacaaccaaatcttggaagaaaatgtggaagtggaaatttggacaaaagaaggggaaaggaagaaattaaaacccagatggttggatgctaggatctattctgacccgctggcgctcaaagaattcaaggaattcgcagctggaagaaagtccctgaccctgaatctaatcacagagatgggtaggcttccaactttcatgactcagaaagcaaggaacgcactggacaacttagcagtcctgcatacggctgaagcaggcggaagggcgtacaatcatgctcttagtgaactgccggagaccctggagacattgcttttactgacacttttggctacagtcacgggcggaatcttcctattcttgatgagcggaaagggtatagggaagatgaccctgggaatgtgctgcataatcacggccagtattctcctatggtacgcacaaatacagccacactggatagcagcttcaataatactggagttttttctcatagtcttgcttattccagaaccagaaaagcagagaacaccccaagacaaccaattaacttacgttgtcatagccatcctcacagtagtggctgcaaccatggcaaacgagatgggtttcctggaaaaaacgaagaaagatttcggattgggaagcattgctacccaccaacccgagagcaacatcctggacatagatctacgtcctgcatcagcatggactctgtatgccgtggccacaacattcatcacaccaatgttgagacatagcattgaaaattcctcagtgaatgtgtccctaacagccattgccaaccaagccacagtgttaatgggtcttgggaaaggatggccattgtcaaaaatggacatcggagttccccttctcgccattgggtgctattcacaagtcaaccccataactctcacagcagcccttcttttattggtagcacattatgctatcatagggccaggactccaagcgaaagcaaccagagaagctcagaaaagagcagcagcgggcatcatgaaaaacccaactgtagatggaataacagtgattgacctagatccaataccctatgatccaaagtttgaaaagcagttgggacaagtaatgctcctagtcctctgcgtgactcaagtattgatgatgaggactacatgggctttgtgtgaggctctaaccctagcgaccgggcccatctccacattgtgggaaggaaatccagggagattttggaatacaaccattgcagtgtcaatggctaacatttttagagggagttacttggccggagctggactcctcttctctatcatgaagaacacagccaacacaagaagaggaactggcaacacaggagagacgcttggagagaaatggaaaaaccgattgaatgcattggggaagagtgaattccagatctacaagaaaagtggaatccaggaagtggatagaaccttagcaaaagaaggcattaaaagaggagaaacggaccatcacgctgtgtcgcgaggctcagcaaaattgagatggttcgtcgagagaaacctggtcacaccagaggggaaggtagtggacctcggttgcggcagagggggctggtcatactattgtgggggactaaagaatgtaagagaagttaaaggcctaacaaaaggaggaccaggacacgaagaacccattcccatgtcaacatatgggtggaatctggtgcgtcttcaaagtggagttgatgttttttttactccgccagaaaagtgtgacacattgctgtgtgatataggggagtcgtcaccaaatcccacggttgaagcaggacgaacactcagagtcttaaacttagtggaaaattggctgaacaacaacacccaattttgcataaaggttctcaacccatacatgccctcagtcatagaaaaaatggaagcgctacaaaggaaatatggaggagctttggtgaggaatccactctcacgaaattccacacatgagatgtactgggtatccaatgcttccgggaatatagtgtcatcagtgaacatgatttcaaggatgttgattaacagatttacaatgagacataagaaggccacatacgagccagatgttgacctcggaagcggaacccgcaacatcggaattgaaagtgagacaccaaatttagacataattggaaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttagactgctgacaaaaccttgggacgtcatccctatggtgacacagatggcaatgacagacacgactccatttggacaacagcgcgttttcaaagagaaagtggacacgagaacccaagaaccgaaagaaggcacgaagaaactaatgaaaatcacggcagaatggctctggaaagaactaggaaagaaaaagacacctaggatgtgcaccagagaagaattcacaagaaaggtgagaagcaatgcagccctaggtgccatattcactgatgagaacaagtggaagtcggcacgtgaggctgttgaagacagtagattttgggaactggttgacaaggaaaggaatctccatcttgaaggaaagtgtgaaacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaagctaggctacattttaagagacgtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacagtaatggatattatatcgagaagagaccaaagaggtagtggacaagttggcacctatggcctcaatactttcaccaatatggaagcccaactaatcagacagatggagggagaaggagtcttcaaaagcatccagcacctgacagtcacagaagaaattgcagtgcaaaactggctagcaagagtggggcgtgagaggttatcaagaatggccatcagtggagatgattgtgttgtgaaacctttagatgacaggtttgccagcgctttaacagctctaaatgatatgggaaaggttaggaaagacatacaacaatgggaaccttcaagaggatggaacgactggacacaagtgcccttttgttcacaccacttccatgagttaatcatgaaagacggtcgtgtactcgtagttccatgtagaaaccaagatgaactgattggtagagcccgaatttcccagggagccgggtggtctttgcgggagacggcctgtttggggaagtcttacgcccaaatgtggagcctgatgtacttccacagacgtgacctcaggctggcggcaaatgctatttgctcggcagtcccatcacattgggttccaacaagccgaacaacttggtccatacacgccagacatgaatggatgacaacggaagacatgctgacagtctggaacagggtgtgggttcaagaaaacccatggatggaagacaaaactccagtggaatcatgggaggaaatcccatacctggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttatggtag

SEQ ID NO: 7104 - RNA, 9876 nt, synthetic construct
  misc_feature 1..9876: note = derived and/or modified CDS sequence (wt) from DENV-2__GQ398259__SS-prME
  source 1..9876: mol_type = other RNA
actgcaggcatgattatcatgttgattccaacagtgatggcgttccatttaaccacacgcaacggagaaccacacatgatcgtcagtagacaagagaaagggaaaagtcttctgtttaaaacagaggatggtgtgaacatgtgtaccctcatggccatggaccttggtgaattgtgtgaagacacaatcacttataattgtcctctcctcaggcagaatgaaccagaagacatagactgttggtgcaactccacgtccacatgggtaacttatgggacatgcaccgccacaggagaacacagaagggaaaaaagatcagtggcactcgttccacatgtgggaatgggactggagacacgaactgaaacatggatgtcatcagaaggggcctggaaacacgcccagagaattgaaacttggatcttgagacatccaggctttaccataatggcagcaatcttggcatacaccataggaacgacatattttcaaagagtcctgattttcatcttgctgacagctgtcgctccttcaatgacaatgcgttgtataggaatatcaaatagagactttgtggaaggggtttcaggaggaagctgggttgacatagtcttagaacatggaagctgtgtgacgacgatggcaaaaaataaaccaacattggattttgaactgataaaaacagaagccaaacaacccgccactctaaggaagtattgtatagaggcaaagctgaccaatacaacaacagcatctcgctgcccaacacaaggggaacccagcctaaatgaagagcaggacaaaaggttcgtttgcaaacattccatggtagacagaggatggggaaatggatgcggattatttggaaagggaggcatcgtgacctgtgctatgttcacatgcaaaaagaacatggaaggaaaagtcgtgcaaccagaaaacttggaatacaccattgtgataacacctcactcaggggaagagaatgcagttggaaatgacacagggaaacacggcaaggaaatcaaaataacaccacagagttccatcacagaagcagaactgacaggctatggcactgtcacgatggagtgctctccgagaacgggcctcgacttcaatgagatggtgttgctgcaaatggaaaacaaagcttggctggtgcacagacaatggttcctagacctgccgttaccatggctgcccggagcggacacacaaggatcaaattggatacagaaggagacattggtcactttcaaaaatcctcatgcgaagaaacaggatgttgttgttttaggatcccaagaaggggctatgcatacagcacttacaggggccacggaaatccagatgtcatcaggaaacttactgttcacaggacatctcaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccatgcaagatcccttttgagataatggatctggaaaaaagacatgtcttaggtcgcctgattacagtcaacccaatagttacagaaaaagacagcccagtcaacatagaagcagaacctccattcggagacagctacatcattataggagtagaaccgggacaactgaagctcaactggtttaagaaaggaagttctatcggccaaatgtttgagacaacaatgagaggagcgaagagaatggccattttaggtgacacagcctgggattttggatccctgggaggagtgttcacatctataggaaaggctctccaccaagtttttggagcaatttatggggctgccttcagtggggtctcatggactatgaaaatcctcataggagttgtcattacatggataggaatgaattcacgcagcacctcactgtctgtgtcactagtattagtgggagtcgtgacattgtatctaggagttatggtgcaggccgatagtggttgcgttgtgagttggaaaaacaaagaactgaaatgtggcagtgggatttttatcacagacaacgtacacacatggacagaacaatacaaattccaaccagaatctccttcaaagctggcttcagctatccagaaagctcatgaagaaggcatttgtggaatccgctcagtaacaagactggagaatctaatgtggaaacaaataacaccagaactgaatcacattctatcagaaaatgaggtaaagttgactatcatgacaggagacattaaaggaatcatgcaggcaggaaaacgatccttgcggcctcagcccactgagctgaagtattcatggaaaacatggggcaaagcgaaaatgctctccacagagcttcataaccagacctttctcattgatggccccgaaacagcagaatgtcccaacacaaacagagcttggaactcactagaagttgaagactatggctttggagtattcaccaccaacatatggctgaaattgaaagaaaggcaggatgtattttgtgactcaaaactcatgtcagcggccataaaagacaacagagccgtccatgccgatatgggttattggatagaaagcgcacttaatgacacatggaagatagagaaagcctcttttatcgaagttaaaagctgccactggccaaagtcacatactctctggagtaatggagtgctagaaagcgagatgataattccaaagaattttgctggaccagtgtcacaacacaactacagaccaggctatcatacacaaacggcaggaccctggcatctaggtaagcttgagatggactttgatttctgcgaaggaaccacagtggtggtgactgaggactgtgggaatagaggaccctctttaagaacaactaccgcctctggaaaactcataacagaatggtgctgccgatcttgcacattaccaccgctaagatacaaaggtgaggatggatgttggtacgggatggaaatcagaccattgaaagagaaagaagagaacttggtcaactctttggtcacagccggacatggacagattgacaacttctcactaggagtcttgggaatggcattgttcctggaagaaatgctcaggacccgagtaggaacgaaacatgcaatattactagttgcagtttctttcgtgacattgatcacagggaacatgtcctttcgagacctggggagagtgatggttatggtgggtgccactatgacggatgacataggcatgggcgtgacttatcttgccctactagcagccttcaaagttagaccaacttttgcagctggactactcttgagaaagctgacctccaaggaattgatgatgaccaccataggaatcgtactcctctctcagagcaccataccagagactatacttgaactgactgatgcgttggctctggggatgatggtcctcaaaatagtgaaaaatatggaaaaatatcaattagcagtgactatcatggctatcttatgcgtcccaaatgcagtgatattacaaaacgcatggaaagtgagttgcacaatattggcagtggtgtccgtttctccactgctcttaacatcctcacagcagaaagcggattggataccattggcattgacgatcaaaggcctcaatccaacagccattttcttaacaaccctttcaagaactagcaagaaaaggagctggccactaaatgaggctatcatggcagtcgggatggtgagcattttagccagttctctcttaaagaatgatattcccatgacaggaccactagtggctggagggcttctcactgtgtgttacgtgctcactggaagatcggccgatttggaactggagagggccgccgatgtaagatgggaagatcaggcagagatatcaggaagcagtccaattctgtcaataacaatatcggaagatggtagcatgtcgataaaaaatgaagaggaagaacaaacattgaccatactcattagaacaggactgctggtgatatcaggactttttcccgtatcaataccaatcacagcagcagcatggtacctgtgggaagtgaagaaacaacgggctggagtattgtgggatgtcccttcacccccacccgtgggaaaggccgaactggaagatggagcctatagaatcaagcagaaagggattcttggatactcccagatcggagccggagtttacaaagaaggaacattccacacgatgtggcacgttacacgtggtgctgttctaatgcataaagggaagagaattgaaccatcatgggcggacgtcaagaaagacctaatatcgtatggaggaggctggaagctagaaggagaatggaaggaaggagaagaagtccaggtcttggcattagagcctggaaagaatccaagagccgtccaaacaaaacccggtcttttcaaaactaacaccggaaccataggcgctgtatctctggacttttctcctggaacgtcaggatctccaatcgtcgacaaaaaaggaaaagttgtgggtctttatggcaatggtgtcgtcacaaggagtggaacatatgtgagtgccatagcccagactgaaaaaagcattgaagacaatccagagattgaagatgacatctttcgaaagaaaagattgaccattatggacctccacccaggagcgggaaagacgaagagataccttccagcaatagtcagagaggccataaaacgaggcttgagaacattaatcctggcccccactagagttgtggcagctgaaatggaggaagctcttagaggacttccaataagataccaaaccccagccatcagagctgagcacactgggcgggagattgtggatctaatgtgccacgccacatttaccatgaggctgctatcaccagttagagtgccaaattacaacctgatcatcatggatgaagcccatttcacagacccagcaagcatagcagctagaggatacatttcaactcgagtagagatgggtgaagcagctgggattttcatgacagccactcctccgggaagcagagacccatttcctcagagcaatgcaccaatcatggatgaagaaagggaaatccctgaacgttcgtggaattctggacatgagtgggttacggattttaaagggaagactgtttggtttgttccaagtataaaagcaggaaatgatatagcagcttgcctgagaaaaaatggaaagaaagtgatacaactcagtaggaagacctttgattctgaatatatcaagactaggaccaatgattgggacttcgtggtcacgactgacatttcagaaatgggtgctaacttcaaggctgagagggttatagaccccagacgctgcatgaaaccagtcatactaacagacggtgaagagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggatgccattgacggtgaataccgcttaagaggagaagcgaggaaaacctttgtggacttaatgagaagaggagacctaccagtctggctggcctacagagtggcagctgaaggtatcaactacgcagacagaaggtggtgttttgatggaatcaagaacaaccaaatcttggaagaaaatgtggaagtggaaatttggacaaaagaaggggaaaggaagaaattaaaacccagatggttggatgctaggatctattctgacccgctggcgctcaaagaattcaaggaattcgcagctggaagaaagtccctgaccctgaatctaatcacagagatgggtaggcttccaactttcatgacccagaaagcaaggaacgcactggacaacttagcagtcctgcatacggctgaagcaggcggaagggcgtacaatcatgctcttagtgaactgccggagaccctggagacattgcttttactgacacttttggctacagtcacgggcggaatcttcctattcttgatgagcggaaagggtatagggaagatgaccctgggaatgtgctgcataatcacggccagtattctcctatggtacgcacaaatacagccacactggatagcagcttcaataatactggagttttttctcatagtcttgcttattccagaaccagaaaagcagagaacaccccaagacaaccaattaacttacgttgtcatagccatcctcacagtagtggctgcaaccatggcaaacgagatgggtttcctggaaaaaacgaagaaagatttcggattgggaagcattgctacccaccaacccgagagcaacatcctggacatagatctacgtcctgcatcagcatggactctgtatgccgtggccacaacattcatcacaccaatgttgagacatagcattgaaaattcctcagtgaatgtgtccctaacagccattgccaaccaagccacagtgttaatgggtcttgggaaaggatggccattgtcaaaaatggacatcggagttccccttctcgccattgggtgctattcacaagtcaaccccataactctcacagcagcccttcttttattggtagcacattatgctatcatagggccaggactccaagcgaaagcaaccagagaagctcagaaaagagcagcagcgggcatcatgaaaaacccaactgtagatggaataacagtgattgacctagatccaataccctatgatccaaagtttgaaaagcagttgggacaagtaatgctcctagtcctctgcgtgactcaagtattgatgatgaggactacatgggctttgtgtgaggctctaaccctagcgaccgggcccatctccacattgtgggaaggaaatccagggagattttggaatacaaccattgcagtgtcaatggctaacatttttagagggagttacttggccggagctggactcctcttctctatcatgaagaacacagccaacacaagaagaggaactggcaacacaggagagacgcttggagagaaatggaaaaaccgattgaatgcattggggaagagtgaattccagatctacaagaaaagtggaatccaggaagtggatagaaccttagcaaaagaaggcattaaaagaggagaaacggaccatcacgctgtgtcgcgaggctcagcaaaattgagatggttcgtcgagagaaacctggtcacaccagaggggaaggtagtggacctcggttgcggcagagggggctggtcatactattgtgggggactaaagaatgtaagagaagttaaaggcctaacaaaaggaggaccaggacacgaagaacccattcccatgtcaacatatgggtggaatctggtgcgtcttcaaagtggagttgatgttttttttactccgccagaaaagtgtgacacattgctgtgtgatataggggagtcgtcaccaaatcccacggttgaagcaggacgaacactcagagtcttaaacttagtggaaaattggctgaacaacaacacccaattttgcataaaggttctcaacccatacatgccctcagtcatagaaaaaatggaagcgctacaaaggaaatatggaggagctttggtgaggaatccactctcacgaaattccacacatgagatgtactgggtatccaatgcttccgggaatatagtgtcatcagtgaacatgatttcaaggatgttgattaacagatttacaatgagacataagaaggccacatacgagccagatgttgacctcggaagcggaacccgcaacatcggaattgaaagtgagacaccaaatttagacataattggaaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttagactgctgacaaaaccttgggacgtcatccctatggtgacacagatggcaatgacagacacgactccatttggacaacagcgcgttttcaaagagaaagtggacacgagaacccaagaaccgaaagaaggcacgaagaaactaatgaaaatcacggcagaatggctctggaaagaactaggaaagaaaaagacacctaggatgtgcaccagagaagaattcacaagaaaggtgagaagcaatgcagccctaggtgccatattcactgatgagaacaagtggaagtcggcacgtgaggctgttgaagacagcagattttgggaactggtggacaaggaaaggaatctccatcttgaaggaaagtgtgaaacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaagctaggctacattttaagagacgtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacagtaatggatattatatcgagaagagaccaaagaggtagtggacaagttggcacctatggcctcaatactttcaccaatatggaagcccaactaatcagacagatggagggagaaggagtcttcaaaagcatccagcacctgacagtcacagaagaaattgcagtgcaaaactggctagcaagagtggggcgtgagaggttatcaagaatggccatcagtggagatgattgtgttgtgaaacctttagatgacaggtttgccagcgctttaacagctctaaatgatatgggaaaggttaggaaagacatacaacaatgggaaccttcaagaggatggaacgactggacacaagtgcccttttgttcacaccacttccatgagttaatcatgaaagacggtcgtgtactcgtagttccatgtagaaaccaagatgaactgattggtagagcccgaatttcccagggagccgggtggtctttgcgggagacggcctgtttggggaagtcttacgcccaaatgtggagcctgatgtacttccacagacgtgatctcaggctggcggcaaatgctatttgctcggcagtcccatcacattgggttccaacaagccgaacaacttggtccatacacgccagacatgaatggatgacaacggaagacatgctgacagtctggaacagggtgtgggttcaagaaaacccatggatggaagacaaaactccagtggaatcatgggaggaaatcccatacctggggaaaagagaagaccaatggtgcggctcattaattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 7105 - RNA, 9876 nt, synthetic construct
  misc_feature 1..9876: note = derived and/or modified CDS sequence (wt) from DENV-2__GQ398268__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctgtttaaaacagaggatggtgtgaacatgtgtaccctcatggccatggaccttggtgaattgtgtgaagatacaatcacgtacaagtgtcctcttctcaggcagaatgaaccagaagacatagattgttggtgcaactctacgtccacatgggtaacttatgggacgtgtaccaccacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccataatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacagaagccaaacaacctgccactctaaggaagtactgtatagaggcaaagctgaccaacacaacaacagaatctcgctgcccaacacaaggagaacccagcctaaatgaagagcaggacaaaaggttcgtctgcaaacactccatggtggacagaggatggggaaatggatgtggattatttggaaaaggaggcattgtgacctgtgctatgttcacatgcaaaaagaacatggaaggaaaagtcgtgcaaccagaaaacttggaatacaccattgtgataacacctcactcaggggaagagcatgcagtcggaaatgacacaggaaaacatggcaaggaaatcaaaataacaccacagagttccatcacagaagcagagttgacaggctatggcactgtcacgatggagtgctctccgagaacgggcctcgacttcaatgagatggtgttgctgcaaatggaaaataaagcttggctggtgcacaggcaatggttcctagacctgccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggaaacttactgttcacaggacatctcaagtgcaggctgaggatggacaaactacagctcaaaggaatgtcatactctatgtgcacaggaaagtttaaagttgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacagaaaaagatagcccagtcaacatagaagcagaacctccattcggagacagctacatcatcataggagtagagccgggacaattgaagctcaactggtttaagaaaggaagttctatcggccaaatgtttgagacaacaatgaggggagcgaagagaatggccattttaggtgacacagcttgggattttggatccctgggaggagtgtttacatctataggaaaggctctccaccaagttttcggagcaatctatggggctgccttcagtggggtctcatggactatgaaaatcctcataggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaagtgtggcagtgggattttcatcacagacaacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcggccccagcccactgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaaaagcaggatgtattctgcgactcaaaactcatgtcagcggccataaaagacaacagagccgtccatgccgatatgggttattggatagaaagtgcactcaatgacacatggaagatagagaaagcctctttcatcgaagttaaaagctgccactggccaaagtcacacaccctctggagtaatggagtgctagaaagtgagatgataattccaaagaatttcgctggaccagtgtcacaacacaactacagaccaggctaccatacacaaacagcaggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccataggaatcgtactcctctcccagagcaccataccagagaccattcttgaactgactgatgcgttagccttgggcatgatggtccttaaaatggtgagaaaaatggaaaagtatcaattggcagtgactatcatggctatcttgtgcgtcccaaatgcagtgatattacaaaacgcatggaaagtgagttgcacaatattggcagtggtgtccgtttccccactgctcttaacatcctcacagcagaaagcggattggataccattagcattgacgatcaagggtctcaatccaacagctatttttctaacaaccctttcaagaaccaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctgtatcaataccaatcacggcagcagcatggtacctgtgggaagtgaagaaacaacgggctggagtattgtgggatgtcccttcacccccacccgtgggaaaggctgaactggaagatggagcctatagaatcaagcaaaaagggattcttggatattcccagatcggagccggagtttacaaagaaggaacattccatacaatgtggcatgtcacacgcggcgctgttctaatgcataaaggaaagaggattgaaccatcatgggcggacgttaagaaagacctaatatcatatggaggaggctggaagctagaaggagaatggaaggaaggagaagaagtccaggtcttggcattggagcctggaaaaaatccaagagccgtccaaacaaaacctggtcttttcaaaaccaacgccggaaccataggtgccgtatctctggacttttctcctggaacctcaggatctccaatcatcgacaaaaaaggaaaagttgtgggtctttatggtaatggtgttgttacaaggagtggagcatatgtgagtgctatagcccagactgaaaaaagtattgaagacaatccagagatcgaagatgacatttttcgaaagagaaaattgaccatcatggacctccacccaggagcgggaaagacgaagagataccttccggccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataaaagcaggaaatgatatagcagcttgcctgagaaaaaatggaaagaaagtgatacaactcagtaggaagacctttgattctgagtatgtcaagactagaaccaatgattgggacttcgtggtcacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagctgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaggatctactctgacccactggcgctaaaggaattcaaggagtttgcagctggaagaaagtccctgaccctgaacctaatcacagaaatgggtaggcttccaactttcatgactcagaaggcaagagacgcactggacaacttagcagtgctgcacacggctgaagcaggtggaagggcgtacaatcatgctctcagtgaactgccggagaccctggagacattgcttttactgacacttctggctacagtcacgggaggaatctttttattcttgatgagcggaaggggtatagggaagatgaccctgggaatgtgttgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcattacaacccagcaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttctcttactggtagcacattatgccatcatagggccaggactccaagcaaaagcaaccagagaagctcagaaaagagcagcagcgggcatcatgaaaaacccaactgtcgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacatttttagagggagttacttggccggagctggacttctcttttccatcatgaagaacacaaccaacacgagaaggggaactggcaacataggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctaacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgagacacaagaaagccacttacgagccagatgtagacctcgggagcggaacccgcaacatcggaattgaaagtgagataccaaacctagacataatcgggaaaagaatagaaaaaataaaacaagagcatgaaacatcatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtgacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtataacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccttgagtggagtggaaggagaagggctgcacaagctaggttacattttaagagacgtgagcaagaaagagggaggagcaatgtatgccgatgacaccgcaggatgggacacaagaatcacactagaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagtcttcaaaagcattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtacttgtagttccatgcagaaaccaagatgaactgattggtagagcccgaatttcccaaggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 7106 - RNA, 9876 nt, synthetic construct
  misc_feature 1..9876: note = derived and/or modified CDS sequence (wt) from DENV-2__GQ398263__SS-prME
  source 1..9876: mol_type = other RNA
actgcaggcatgattatcatgatgattccaacagtgatggcgttccatttaaccacacgcaacggagaaccacacatgatcgtcagtagacaagagaaagggaaaagtcttctgtttaaaacagaggatggtgtgaacatgtgtaccctcatggccatggaccttggtgaattgtgtgaggacacaatcacttataattgtcctcttctcaggcagaatgaaccagaagacatagactgttggtgcaattctacgtccacatgggtaacttatgggacatgcaccgccacaggagaacacagaagggaaaaaagatcagtggcactcgttccacatgtgggaatgggactggagacacgaactgaaacatggatgtcatcagaaggggcctggaaacacgcccagagaattgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcaaaaaacaaaccaacattagattttgaactgataaaaacagaagctaaacatcccgccactctaaggaagtattgtatagaggcaaagctgaccaacacaacaacagcatctcgctgcccaacacaaggggaacctagcctaaatgaagagcaggacaaaaggttcgtctgcaaacattccatggtagacagaggatggggaaatggatgcggactatttggaaagggaggcatcgtgacctgtgcaatgttcacatgcaaaaagaacatggaaggaaaagtcgtgcaaccagaaaacttggaatacaccattgtgataacacctcactcaggggaagagaatgcagtcggaaatgacacaggaaaacacggcaaggaaattaaaataacaccacagagttccatcacagaagcagaactgacaggctatggcactgtcacgatggaatgctctccgagaacgggcctcgacttcaatgagatggtgttgctgcaaatggaaaacaaggcttggctggtgcacaggcaatggttcctagacctgccgttaccatggctgcccggagcggacacacaaggatcaaattggatacagaaggagacattggtcactttcaaaaatccccatgcgaagaaacaggatgttgttgttttaggatcccaagaaggggctatgcatacagcacttacaggggccacggaaatccagatgtcatcaggaaacttactgttcacaggacatctcaagtgcaggctgagaatggacaaactacagctcaaaggaatgtcatattctatgtgtacaggaaagttcaaagttgtgaaggaaatagcagaaacacaacatggaacaatagttgtcagagtacaatatgaaggggacggttctccgtgcaagatcccttttgaaataatggatttggaaaaaagacatgtcttaggtcgcctgattacagtcaacccaattgttacagaaaaagacagcccagtcaacatagaagcagaacctccattcggagacagctacatcattataggagtagaaccgggacaactgaagctcagctggtttaagaaaggaagttctatcggccaaatgtttgagacaacaatgagaggagcgaagagaatggccattttaggtgacacagcttgggattttggatccctgggaggagtgttcacatctataggaaaggctctccaccaagtttttggagcaatctatggggctgccttcagtggggtctcatggactatgaaaatcctcataggagttgtcatcacatggataggaatgaattcacgcagcacctcactgtctgtgtcactagtattagtgggggtcgtgacattgtatttgggagttatggtgcaggccgatagtggctgcgttgtgagttggaaaaacaaagaactgaaatgtggcagtgggatttttatcacagacaacgtacacacatggacagaacaatacaaattccaaccagaatccccttcaaagttggcttcagctatccagaaagctcatgaagagggcatttgtggaatccgctcagtgacaagactggagaatctgatgtggaaacagataacaccagaactgaatcacattctatcagaaaatgaggtaaagttgactatcatgacaggagacattaaaggaatcatgcaggcaggaaaacgatccctgcggcctcagcccactgagctgaagtattcatggaaaacatggggcaaagcgaaaatgctctccacagagcttcataaccacacctttctcattgatggccccgaaacagcagaatgtcccaccacaaacagagcttggaactcactagaagttgaagactatggctttggagtattcaccactaacatatggctgaaattgaaagaaaggcaggatgtactttgtgactcaaaactcatgtcagcggccataaaagacaacagggccgtccatgccgatatgggctattggatagaaagtgcacttaatgacacatggaagattgagaaagcctcttttatcgaagttaaaagctgccactggccaaagtcacacaccctctggagtaatggagtgctagaaagtgagatgataattccaaagaattttgctggaccagtatcacaacacaactatagaccaggctatcacacacaaacggcaggaccctggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgttaaggtacagaggtgaggatggatgctggtacgggatggaaatcagaccattgaaagataaagaagagaacttagtcaactctttggtcacagccggacatggacagattgacaacttctcactaggagtcttgggaatggcattgttcctggaagaaatgctcaggacccgagtaggaacgaaacatgcaatactactagttgcagtttctttcgtgacattgatcacagggaacatgtcctttcgagacttggggagagtgatggttatggtgggcgctactatgacggatgacataggcatgggtgtgacttatcttgccctattagcagccttcaaagtcagaccaacttttgcagctggactactcttgagaaagctgacctccaaggaattgatgatgaccaccataggaatcgtactcctctctcagagcaccataccagagactatacttgaactgactgatgcgttggctttggggatgatggtcctcaaaatagtgagaaatatggaaaagtatcaattagcagtgactatcatggccatcttgtgcgtcccaaacgcagtgatattacaaaacgcatggaaagtgagttgcacaatactggcagtggtgtccgtttccccactgctcttaacatcctcacagcagaaagcggattggataccactagcattgacgatcaaaggcctcaatccaacagccattttcctaacaaccctctcaagaactagcaagaaaaggagctggccactaaatgaggctattatggcagtcgggatggtgagcattttagccagttctcttttaaagaatgatattcccatgacaggaccattagtggctggagggcttctcactgtgtgttatgtgctcactggaagatcggccgatttggaactggagagagccgctgacgtaagatgggaagatcaggcagagatatcaggaagtagtccaattctgtcaataacaatatcggaagatggtagcatgtcgataaaaaatgaggaggaagaacaaacactgaccatactcattagaacaggactgctggtgatatcaggactttttcccgtgtcaataccaatcacggcagcagcatggtacctgtgggaagtgaagaaacaacgagctggagtattgtgggatgtcccttcacccccacctgtgggaaaggccgaactggaagatggagcctacagaatcaagcagaaagggattcttggatactcccagatcggagccggagtttacaaagaaggaacattccacacaatgtggcacgtcacacgtggtgctgttctaatgcacaaagggaagagaattgaaccatcatgggcggacgttaggaaagacctaatatcgtatggaggaggctggaagctagaaggagaatggaaggaaggagaagaagtccaggtcttggcattagagcctggaaagaatccaagagccgtccaaacaaaacccggtcttttcaaaactaacaccggaaccataggcgccgtatctctggacttttctcctggaacgtcaggatctccaatcgtcgacaaaaaaggaaaagttgtgggcctttatggcaatggtgtcgtcacaaggagtggaacatatgtgagtgccatagcccagactgaaaaaagcattgaagacaatccagagattgaagatgacatctttcgaaagaaaagattgaccatcatggacctccacccaggagcgggaaagacgaagagataccttccagcaatagtcagagaggccataaaacgaggcttgagaacattaatcctggcccccactagagttgtggcggctgaaatggaggaagctctcagaggacttccaataagataccaaaccccagctatcagagctgagcacactgggcgggagattgtggatctaatgtgtcacgccacatttaccatgaggctgctatcaccagttagagtgccaaattacaacctgatcatcatggatgaagcccatttcacagacccagcaagcatagcagctagaggatacatttcaactcgagtagagatgggtgaagcagctgggattttcatgacagccactcctccgggaagcagagatccatttcctcagagcaatgcaccaatcatggatgaagaaagggaaatccctgaacgttcgtggaattctggacatgagtgggttacggattttaaagggaaaactgtttggtttgttccaagcataaaagcaggaaacgatatagcagcttgtctgaggaaaaatggaaagaaagtgatacaactcagcaggaagacctttgattctgaatatatcaagactaggaccaatgattgggacttcgtggtcacgacagacatttctgaaatgggtgctaacttcaaggctgagagggttatagaccccagacgctgcatgaaaccagtcatactaacagacggtgaagagcgggtgatcctggcaggacccatgccagtgacccattctagtgcagcacaaagaagagggagaataggaagaaatccaaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggatgccattgatggtgaataccgcttaagaggagaagcgaggaaaacttttgtggacctaatgagaagaggagacctaccagtctggctggcctacagagtggcagctgaaggtatcaactacgcagacagaaggtggtgttttgatggaatcaagaacaaccaaatcttggaagaaaatgtggaagtggaaatttggacaaaagaaggagaaaggaagaaattaaaacctagatggttggatgctaggatctactctgacccactggcgctcaaagaattcaaggaattcgcagctggaagaaagtccctgaccctgaatctaatcacagagatgggtaggcttccaaccttcatgactcagaaagcaaggaacgcactggacaacttagcagtcctgcatacggctgaagcaggcggaagggcgtacaatcatgctcttagtgaactgccggagaccctggagacattgctcttactgacacttttggccacagtcacgggcggaatctttctattcttgatgagcggaaagggtatagggaagatgaccctgggaatgtgctgcataatcacggccagtattctcctatggtacgcacaaatacagccacactggatagcagcttcaataatactggagttttttctcatagtcttgcttattccagaaccagaaaagcagagaacaccccaagataaccaattaacttatgttgtcatagccatcctcacagtggtggccgcaaccatggcaaacgagatgggtttcctggaaaaaacgaagaaagatttcggattgggaagcattgcaacccagcaacctgagagcaacatcctggacatagatctacgtcctgcatcagcatggactttatatgccgtggcaacaacattcatcacaccaatgttgagacatagcattgaaaattcctcagtgaatgtgtctctaacagctattgccaaccaagccacagtgttaatgggtcttgggaaaggatggccattgtcaaaaatggacatcggagttccccttcttgccattgggtgctattcacaagtcaaccccataactctcacagcagcccttcttttactggtagcacattatgctatcatagggccaggactccaagcgaaagcaaccagagaagctcaaaaaagagcagcagcgggcatcatgaaaaacccaactgtggatggaataacagtgattgacctagatccaataccctatgatccaaagtttgaaaagcagttgggacaagtaatgctcctagtcctctgcgtgacccaagtattgatgatgaggactacatgggctttgtgtgaggctctaaccttagcgaccgggcccatctccacattgtgggaaggaaatccagggagattttggaatacaactattgcagtgtcaatggctaacatttttagagggagttacttggccggagccggacttctcttttctatcatgaagaacacagccaacacaagaaggggaactggcaacacaggagagacgcttggagagaaatggaaaaaccgattgaatgcattggggaagagtgaattccagatctataagaaaagcggaatccaggaagtggatagaaccctagcaaaagaaggcattaaaagaggagaaacggaccaccacgctgtgtcgcgaggctcggcgaaactgagatggttcgtcgagagaaacctggtcacaccagaggggaaagtagtggacctcggctgcggcagagggggctggtcatactactgtgggggactaaagaatgtaaaagaagtcaaaggcctaacaaaaggaggaccaggacacgaagaacccattcccatgtcaacatatgggtggaatctggtgcgtcttcaaagtggagttgatgttttttttactccgccagaaaagtgtgacacattgctgtgtgacataggagagtcgtcaccaaatcccacggttgaggcaggacgaacactcagagttttaaacttagtggaaaattggctgaacaacaacacccaattttgcataaaggttctcaacccatacatgccctcagtcatagaaaaaatggaagcgctgcaaaggaaatatggaggagctttggtgaggaatccactctcacgaaattccacacatgagatgtactgggtatccaatgcttccgggaatatagtgtcatcagtgaacatgatttcaaggatgttgattaatagatttacaatgagacataagaaggccacatacgagccagatgttgacctcggaagcggaacccgcaacatcggaattgaaagtgagataccaaatttagacgtaattggaaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaagaaactaatgaaaatcacggcagaatggctctggaaagaactaggaaagaaaaagacacctaggatgtgcaccagagaagaattcacaagaaaggtgagaagcaatgcagccctaggtgccatatacactgatgagaacaagtggaagtcggcacgtgaggctgttgaagatagcagattttgggaactggttgacaaggaaaggaatctccatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaagctaggctacattttaagagacgtgagcaagaaagaaggaggagcaatgtacgccgatgacaccgcaggatgggacacaagaatcacactagaggacttaaaaaatgaagaaatggtgacaaaccacatggaaggagaacataagaaacttgctgaggccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaattaatcagacagatggagggagaaggagtcttcaaaagcatccagcacctgacagtcacagaagaaattgcagtgaaaaactggttagcaagagtggggcgtgagaggttatcaagaatggccatcagtggagatgattgtgttgtaaaacctttagatgacaggtttgcaagcgctttaacagctctaaatgacatgggaaaagttaggaaagacatacaacaatgggaaccttcaagaggatggaacgattggacacaagtgcccttttgttcacaccatttccatgagttaatcatgaaagacggtcgtgtactcgtagttccatgtagaaaccaagatgaactgattggtagagcccgaatttcccagggagccgggtggtctttgcgggagacagcctgtttggggaagtcttacgcccaaatgtggagcctgatgtacttccacagacgtgaccttaggctggcggcaaatgctatatgctcggcagtcccatcacattgggttccaacaagtcgaacaacctggtctatacacgccacacatgaatggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactatatgccatccatgaaaagattcagaagagaagaggaagaggcaggagtcttgtggtag

SEQ ID NO: 7107 - RNA, 9876 nt, synthetic construct
  misc_feature 1..9876: note = derived and/or modified CDS sequence (wt) from DENV-2__GQ398264__SS-prME
  source 1..9876: mol_type = other RNA
actgcaggcatgattatcatgatgattccaacagtgatggcgttccatttaaccacacgcaacggagaaccacacatgatcgtcagtagacaagagaaagggaaaagtcttctgtttaaaacagagaacggtgtgaacatgtgtaccctcatggccatggaccttggtgaattgtgtgaagacacaatcacttataattgtcctcttctcaggcagaatgaaccagaagacatagactgttggtgcaactctacgtccacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcaaaaaataaaccaacattggattttgaactgataaaaacagaagccaaacatcccgccactctaaggaagtattgtatagaggcaaagctgaccaacacaacaacagcatctcgctgcccaacacaaggggaacctagcctaaatgaagagcaggacaaaaggtttgtctgcaaacattccatggtagacagaggatggggaaatggatgcggattatttggaaagggaggcatcgtgacctgtgcaatgttcacatgcaaaaagaacatggaaggaaaagtcgtgcaaccagaaaacttggaatacaccattgtgataacacctcactcaggggaagagaatgcagtcggaaatgacacaggaaaacacggcaaggaaattaaaataacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcggacacacaaggatcaaattggatacagaaggagacattggtcactttcaaaaatccccatgcgaagaaacaggatgttgttgttttaggatcccaagaaggggctatgcatacagcacttacaggggccacggaaatccagatgtcatcaggaaacttactgttcacaggacatctcaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcctgattacagtcaacccaattgttacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggctctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtgcacacatggacagaacaatacaaattccaaccagaatccccttcaaagctggcttcagctatccagaaggctcatgaagagggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcggcctcagcccactgagctgaagtattcatggaaaacatggggcaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaattgaaagaaaggcaggatgtattttgtgactcaaaactcatgtcagcggccataaaagacaacagagccgtccatgccgatatgggctattggatagaaagcgcacttaatgacacatggatgattgagaaagcctcttttatcgaagttaaaagctgccactggccaaagtcacacactctctggagtaatggagtgctagaaagtgagatgataattccaaagaattttgcaggaccagtgtcacaacacaactacagaccaggctatcatacacaaacggcaggaccctggcagctaggtaagcttgagatggactttgatttctgcgaaggaaccacagtggtggtgactgaggattgtggaaatagaggaccctctttaagaacaactactgcctctggaaaactcataacagaatggtgctgccgatcttgcacattaccaccgctaaggtacagaggtgaggatggatgttggtacgggatggaaatcagaccattgaaagagaaagaagagaacttggtcaactctttggtcacagccggacatggacagattgacaacttctcactaggagtcttgggaatggcattgttcctggaagaaatgctcaggacccgagtaggaacgaaacatgcaatattactagttgcagtttctttcgtgacattgatcacagggaacatgtcctttcgagatttggggagagtgatggttatggtgggcgctactatgacggatgacataggcatgggcgtgacttatcttgccctattagcagccttcaaagtcagaccaacttttgcagctggactactcttgagaaagctgacctccaaggaattgatgatgaccaccataggaatcgtactcctctctcagagcaccataccagagactatacttgaactgactgatgcgttggctttggggatgatggtcctcaaaatagtgagaaacatggaaaagtatcaattagcagtgactatcatggccatcttgtgcgtcccaaatgcagtgatattacaaaacgcatggaaagtgagctgcacaacactggcagtggtgtccgtttccccactgctcttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtagctggagggctcctcactgtgtgttacgtgctcactggaagatcggccgatttggaactggagagagccgctgacgtaagatgggaagatcaggcagagatatcaggaagtagtccaattctgtcaataacaatatcggaagatggtagcatgtcgataaaaaatgaagaagaagaacaaacactgaccatactcattagaacaggactgctggtgatatcaggactttttcccgtgtcaataccaatcacggcagctgcatggtacctgtgggaagtgaagaaacaacgagccggagtattgtgggatgtcccttcacccccacctgtgggaaaggctgaactggaagatggagcctacagaatcaagcagaaagggattcttggatactcccagatcggagccggagtttacaaagaaggaacattccatacaatgtggcacgtcacacgtggtgctgttctaatgcataaagggaagagaattgaaccatcatgggcggacgttaggaaagacctaatatcgtatggaggaggctggaagttagaaggagaatggaaggaaggagaagaagtccaggtcctggcattagagcctggaaagaatccaagagccgtccaaacaaaacccggtcttttcaaaactaacactggaaccataggcgccgtttctctggacttttctcctggaacgtcaggatctccaatcgtcgacaaaaaaggaaaagttgtgggcctttatggcaatggtgtcgtcacaaggagtggaacatatgtgagtgccatagcccagactgaaaaaagcattgaagacaatccagagattgaagatgacatctttcgaaagaaaagattgaccatcatggacctccacccaggagcgggaaagacgaagagataccttccagcaatagtcagagaagccataaaacgaggcttgagaacattaatcctggcccccactagagttgtggcggctgaaatggaggaagctctcagaggacttccaataagataccaaaccccagctatcagagctgagcacactgggcgggagattgtggatctaatgtgtcacgccacatttaccatgaggctgctatcaccagttagagtgccaaattacaacctgatcatcatggatgaagcccatttcacagacccagcaagcatagcagctagaggatacatttcaactcgagtagagatgggtgaagcagctgggattttcatgacagctactcctccgggaagcagagacccatttcctcagagcaatgcaccaatcatggatgaagaaagggaaatccctgagcgttcgtggaattctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggacttcgtggtcacgacagacatttcagaaatgggtgctaacttcaaggctgagagggttatagaccccagacgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggatgccattgatggtgaataccgcttaagaggagaagcgaggaaaacttttgtggacctaatgagaagaggagacctaccagtctggctggcctacagagtggcagctgaaggtatcaactacgcagacagaaggtggtgttttgatggagtcaagaacaaccaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgactcagaaagcaaggaacgcactggacaacttagcagtcctgcatacggctgaagcaggcggaagggcgtacaatcatgctcttagtgaactgccggagaccctggagacattgcttttactgacacttttggccacagtcacgggcggaatcttcctattcttgatgagcggaaagggtatagggaagatgaccctgggaatgtgctgcataatcacggccagtattctcctatggtacgcacaaatacagccacactggatagcagcttcaataatactggagttttttctcatagtcttgctcattccagaaccagaaaagcagagaacaccccaagataaccaattaacttatgttgtcatagccatcctcacagtggtggccgcaaccatggcaaacgagatgggtttcctggaaaaaacaaagaaagatttcggattgggaagcactgcaacccagcaacctgagagcaacatcctggacatagatctacgtcctgcatcagcttggactctatatgccgtggcaacaactttcatcacaccgatgttgagacatagcattgaaaattcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcacagcagcccttctcttattggtagcacattatgctatcatagggccaggactccaagcgaaagcaaccagagaagctcagaaaagagcagcagcgggcatcatgaaaaacccaactgtggatggaataacagtgattgacctagatccaataccctatgatccaaagtttgaaaagcagttgggacaagtaatgctcctagtcctctgcgtgactcaagtattgatgatgaggactacatgggctttgtgtgaagctctaaccttagcgaccgggcccatctctacattgtgggaaggaaatccagggagattttggaatacaactattgcagtgtcaatggctaacatttttagagggagttacttggccggagccggacttctcttttctatcatgaagaacacggccaacacaagaaggggaactggcaacacaggagagacgcttggagagaaatggaaaaaccgattgaatgcattggggaagagtgaattccagatctataagaaaagtggaatccaggaagtggatagaaccttagcaaaagaaggcatcaaaagaggagaaacggaccatcacgctgtgtcgcgaggctcggcgaaactgagatggttcgtcgagagaaacctggtcacaccagaagggaaagtagtggacctcggctgcggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgttttttttactccgccagaaaagtgtgacacattgctgtgtgacataggggagtcgtcaccaaatcccacggttgaggcaggacgaacactcagagttctaaacttagtggaaaattggctgaacaacaacacccaattttgcataaaggttctcaacccatatatgccctcagtcatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagcggaacccgcaacatcggaattgaaagtgagacaccaaatttagacataattggaaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccctaggtgccatattcactgatgagaacaagtggaagtcggcacgtgaggctgttgaagatagtggattttgggaactggttgacaaggaaaggaatctccatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggatattatatcgagaagagaccaaagaggtagtggacaagttgtcacctacggcctcaatactttcaccaacatggaagcccaactgatcagacagatggagggagaaggagtcttcaaaagcatccagcacctgacagtcacagaagaaattgcagtgaaaaactggttagcaagagtggggcgtgagaggttatcaagaatggccatcagtggagatgattgtgttgtgaaacccttagatgacaggtttgcaagcgctttaacagctctaaatgacatgggaaaggttaggaaagacatacaacaatgggaaccttcaagaggatggaacgattggacacaagtgcccttttgttcacaccatttccatgagttaatcatgaaggacggtcgtgtactcgtagttccatgtagaaaccaagatgaactgattggtagggcccgaatttcccagggagccgggtggtctttgcgggaaacagcctgtttggggaagtcttacgcccaaatgtggagcctgatgtacttccacagacgtgaccttaggctggcggcaaatgctatttgctcggcagtcccatcacattgggttccaacaagtcgaacaacctggtccatacacgccacacatgaatggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactatatgccatccatgaaaagattcagaagagaagaggaagaggcaggagtcttgtggtag

SEQ ID NO: 7108 - RNA, 9876 nt, synthetic construct
  misc_feature 1..9876: note = derived and/or modified CDS sequence (wt) from DENV-2__GQ398260__SS-prME
  source 1..9876: mol_type = other RNA
actgcaggcatgattatcatgttgattccaacagtgatggcgttccatttgaccacacgcaacggagaaccacacatgatcgtcagtagacaagagaaagggaaaagtcttctgtttaaaacagaggatggtgtgaacatgtgtaccctcatggccatggatcttggtgaattgtgtgaagacacaatcacttataattgtcctcttctcaggcagaatgaaccagaagacatagactgttggtgcaactccacgtccacatgggtaacttatgggacatgcaccgccacaggagaacacagaagggaaaaaagatcagtggcactcgttccacatgtgggaatgggactggagacacgaactgaaacatggatgtcatcagaaggggcctggaaacacgcccagagaattgaaacttggatcttgagacatccaggctttaccataatggcagcaatcttggcatacaccataggaacgacatattttcaaagagtcctgattttcatcttgctgacagctgtcgctccttcaatgacaatgcgttgtataggaatatcaaatagagactttgtggaaggggtttcaggaggaagctgggttgacatagtcttagagcatggaagctgtgtgacgacgatggcaaaaaataaaccgacattggattttgaactgataaaaacagaagccaaacaacccgctactctaaggaagtattgtatagaggcaaagctgaccaacacaacaacagcatctcgctgcccaacacaaggggaacccagcctaaatgaagagcaggacaaaaggttcgtctgcaaacattccatggtagacagaggatggggaaatggatgcggattatttggaaagggaggcatcgtgacctgtgctatgttcacatgcaaaaagaacatggaaggaaaagtcgtgcaaccagaaaacttggaatacaccattgtgataacacctcactcaggggaagagaatgcagtcggaaatgacacaggaaaacacggcaaggaaatcaaaataacaccacagagttccatcacagaagcagaactgataggctatggcactgtcacgatggagtgttctccgagaacgggcctcgacttcaatgagatggtgttgctgcaaatggaaaacaaagcttggctggtgcacagacaatggttcttagacctgccgttaccatggctgcccggagcggacacacaaggatcaaattggatacaaaaggagacattggtcactttcaaaaatcctcatgcgaagaaacaggatgttgttgtcttaggatcccaagaaggggctatgcatacagcacttacaggggccacggaaatccagatgtcatcaggaaacttactgttcacaggacacctcaagtgcaggctgagaatggacaaactacagctcaaaggaatgtcatattctatgtgtacaggaaagtttaaagttgtgaaggaaatagcagaaacacaacacggaacaatagttatcagagtacaatatgaaggggacggttctccatgcaagatcccttttgagataatggatttggaaaaaagacatgtcttaggtcgcttgattacagtcaacccaattgttacagaaaaagacagcccagtcaacatagaagcagaacctccattcggagacagctacatcattataggagtagaaccgggacaactgaagctcaactggttcaagaaaggaagttctatcggccaaatgtttgagacaacaatgagaggagcgaagagaatggccattttaggtgacacagcctgggatttcggatccctgggaggagtgttcacatctataggaaaggctctccaccaagtttttggagcaatttatggggctgccttcagtggggtctcatggactatgaaaatcctcataggagttgtcattacatggataggaatgaattcacgcagcacctcactctctgtgtcactagtattagtgggagtcgtgacattgtatttgggagttatggtgcaggccgatagtggttgcgttgtgagttggaaaaacaaagaactgaaatgtggcagtgggatttttgtcacagacaacgtacacacatggacagaacaatacaaattccaaccagaatctccttcaaagctggcttcagctatccagaaagctcatgaagaaggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccttgcggcctcagcccactgagctgaagtattcatggaaaacttggggcaaagcgaaaatgctctctacagagcttcataaccagacctttctcattgatggccccgaaacagcagaatgtcccaacacaaacagagcttggaactcactagaagttgaagactatggctttggagtattcaccaccaacatatggctgaaattgaaagaaaggcaggatgtattttgtgactcaaaactcatgtcagcggccataaaagacaacagagccgtccatgccgatatgggttattggatagaaagcgcactcaatgacacatggaagatagagaaagcctcttttatcgaagttaaaagctgccactggccgaagtcacatactctctggagtaatggagtgctagaaagcgagatgataattccaaagaattttgctggaccagtgtcacaacacaactacagaccaggctatcacacacaaacggcaggaccctggcatctaggtaagcttgagatggactttaatttctgcgaaggaactacagtggtggtgaccgaggactgtgggaatagaggaccctctttaagaacaactaccgcctctggaaaactcataacagaatggtgctgccgatcttgcacattaccaccgctaagatacagaggtgaggatggatgttggtacgggatggaaatcagaccattgaaagagaaagaagaaaacttggtcaactctttggtcacagccggacatggacagattgacaacttctcactaggagtcttgggaatggcattgttcctggaagaaatgctcaggacccgagtaggaacgaaacatgcaatattactagttgcagtttcttttgtgacattgatcacagggaacatgtcctttcgagacctggggagagtgatggttatggtgggtgccactatgacggatgacataggcatgggcgtgacttatcttgccctactagcagccttcaaagttagaccaacttttgcagctggactactcttgagaaagctgacctccaaggaattgatgatgaccaccataggaatcgtactcctctctcagagcaccataccagagactatacttgaactgactgatgcgttggctctggggatgatggtcctcaaaatagtgagaaatatggaaaagtatcaattagcagtgactatcatggctatcttgtgcgtcccaaatgcagtgatattacaaaacgcatggaaagtgagttgcacaatactggcagtggtgtccgtctctccactgctcttaacatcctcacagcagaaagcggattggataccattggcattgacgatcaaaggcctcaatccaacagccattttcttaacaaccctttcaagaactagcaagaaaaggagctggccactaaatgaggctatcatggcagtcgggatggtgagcattttagccagttctctcttaaagaatgatatccccatgacaggaccactagtggctggagggcttctcaccgtgtgttacgtgctcactggaagatcggccgatttggaactggagagggccgccgacgtgagatgggaagatcaggcagagatatcaggaagcagtccaattctgtcaataacaatatcggaagatggtagcatgtcgataaaaaatgaagaggaagaacaaacactgaccatactcattagaacaggactgctggtgatatcaggactttttcccgtatcaataccaatcacggcagcagcatggtacctgtgggaagtgaagaaacaacgggctggagtattgtgggatgtcccttcacccccacccgtgggaaaggccgaactggaagatggagcttatagaatcaagcagaaagggattcttggatactcccagatcggagccggagtttacaaagaaggaacattccacacgatgtggcacgttacacgtggtgctgttctaatgcataaaggaaagagaattgaaccatcatgggcggacgtcaagaaagacctaatatcgtatggaggaggctggaagctagaaggagaatggaaggaaggagaagaagtccaggtcttggcattagagcctggaaagaatccaagagccgtccaaacaaaacccggtcttttcaaaactaacaccggaaccataggcgccgtgtctctggacttttctcctggaacgtcaggatctccaatcgtcgacaaaaaaggaaaagttgtgggtctttatggcaatggtgtcgtcacaaggagtggaacatatgtgagtgccatagcccagactgaaaaaagcattgaagacaatccagagattgaagatgacatctttcgaaagaaaagattgaccattatggacctccacccaggagcgggaaagacgaagagataccttccagcaatagtcagagaggctataaaacgaggcttgagaacattaatcctggcccccactagagtcgtggcagccgaaatggaggaagctcttagaggacttccaataagataccaaaccccagccatcagagctgagcacactgggcgggagattgtggatctaatgtgccacgccacatttaccatgaggctgctatcaccagttagagtgccaaattacaacctgatcatcatggatgaagcccatttcacagacccagcaagcatagcagctagaggatacatttcaactcgagtagagatgggtgaagcagctgggattttcatgacagccactcctccgggaagcagagacccatttcctcagagcaatgcaccaatcatggatgaagaaagggaaatccctgaacgttcgtggaattctggacatgagtgggttacggactttaaagggaagactgtttggtttgttccaagtataaaagcaggaaatgatatagcagcttgcctgagaaaaaatggaaagaaagtgatacaactcagtagaaagacctttgattctgaatatatcaagactaggaccaatgattgggacttcgtggtcacgactgacatttcagaaatgggtgctaacttcaaggctgagagggttatagaccccagacgctgcatgaaaccagtcatactaacagacggtgaagagcgggtgatcctggcaggacccatgccagtgacccactctagtgcagcacaaagaagagggagaataggaagaaatccaaaaaatgaaaatgaccagtacatatacatgggggaacctctggaaaatgatgaagactgtgcacattggaaagaagctaagatgcttctagataacatcaacacgcctgaaggaatcattcccagcatgttcgaaccagagcgtgaaaaggtggatgccattgatggtgaataccgcttaagaggagaagcgaggaaaacctttgtggacctaatgagaagaggagacctaccagtctggctggcctacagagtggcagctgaaggtatcaactacgcagacagaaggtggtgttttgatggaatcaagaacaaccaaatcttggaagaaaatgtggaagtggaaatttggacaaaagaaggggaaaggaagaaattaaaacccagatggttggatgctaggatctattctgacccgctggcgctcaaagaattcaaggaattcgcagctggaagaaagtccctgaccctgaatctaatcacagagataggtaggcttccaactttcatgactcagaaagcaaggaacgcactggacaacttagcagtcctgcatacagctgaagcaggcggaagggcatacaatcatgctcttagtgaactgccggagaccctggagacattgcttttactgacacttttggctacagtcacgggcggaatctttctattcttgatgagcggaaagggtatagggaaaatgaccctgggaatgtgctgcataatcacggccagtattctcctatggtacgcacaaatacaaccacactggatagcagcttcaataatactggagttttttctcatagtcttgcttattccagaaccagaaaagcagagaacaccccaagacaaccaattaacttacgttgtcatagccatcctcacagtggtagctgcaaccatggcaaacgagatgggtttcctggaaaaaacgaagaaagatttcggattgggaagcattgcaacccagcaacccgagagcaacatcctggacatagatctacgtcctgcatcagcatggactctgtatgccgtggccacaacattcatcacaccaatgttgagacatagcattgaaaattcctcagtgaatgtttccctaacagctattgccaaccaagccacagtgttaatgggtcttgggaaaggatggccattgtcaaaaatggacatcggagttccccttctcgccattgggtgctattcacaagtcaaccccataactctcacagcagcccttcttttattggtagcacattatgctatcatagggccaggactccaagcgaaagcaaccagagaagctcagaaaagagcagcagcgggcatcatgaaaaacccaactgtagatggaataacagtgattgacctagatccaataccctatgatccaaagtttgagaagcagttgggacaagtaatgctcctagtcctctgcgtgactcaagtattgatgatgaggactacatgggctttgtgtgaggctctaaccctagcgaccgggcccatctccacattgtgggaaggaaacccagggagattttggaatacaactattgcagtgtcaatggctaacatttttagagggagttacttggccggagctggactcctcttttctatcatgaagaatacagccaacacaagaaggggaactggcaacacaggagagacgctaggagagaaatggaaaaaccgattgaatgcattggggaagagtgaattccagatctacaagaaaagtggaattcaggaagtggatagaaccttagcaaaagaaggcattaaaagaggagaaacggaccatcacgctgtgtcgcgaggctcagcaaaactgagatggttcgtcgagagaaacctggtcacaccagaggggaaagtagtggacctcggttgcggcagagggggctggtcatactattgtgggggactaaagaatgtaagagaagtcaaaggcctaacaaaaggaggaccaggacacgaagaacccattcccatgtcaacatatgggtggaatctggtgcgtcttcaaagtggagttgatgttttttttactccgccagaaaagtgtgacacattgctgtgtgacataggggagtcgtcaccaaatcccacgattgaagcaggacgaacactcagagtcttaaacttagtggaaaattggctgaacaacaacacccaattttgtataaaggttctcaacccatacatgccctcagtcatagaaaaaatggaagcgctacaaaggaaatacggaggagctttggtgaggaatccactctcacgaaattccacacatgagatgtactgggtttccaatgcttccgggaacatagtgtcatcagtgaacatgatttcaaggatgttgattaacagatttacaatgagacataagaaggccacatacgagccagatgttgacctcggaagcggaacccgcaacatcggaattgaaagtgagacaccaaacttagacataattggaaaaagaatagaaaaaataaaacaagagcatgaaacatcatggcactatgaccaagaccacccatacaaaacgtgggcctaccatggcagctacgaaacaaaacagaccggatcagcatcatccatggtgaacggagtagttagattgctgacaaaaccttgggacgtcatccctacggtgacacagatggcaatgacagacacgactccatttggacaacagcgcgttttcaaagagaaagtggacacgagaacccaagaaccgaaagaaggcacgaagaaactaatgaaaatcacggcagaatggctctggaaagaactaggaaagaaaaagacacctaggatgtgcaccagagaagaattcacaagaaaggtgagaagcaatgcagccctaggtgccatattcactgatgagaacaagtggaagtcggcacgtgaggctgttgaagacagtagattttgggaactggttgacaaggaaaggaatctccatcttgaaggaaagtgtgaaacatgtgtgtacaacatgatgggaaagagagagaagaagctaggggagtttggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaagctaggctacattttaagagatgtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacggtaatggatattatatcgagaagagaccaaagaggtagtggacaagttggcacctatggtctcaatactttcaccaatatggaagcccaactaatcagacagatggagggagaaggagtcttcaaaagcatccagcacctgacagtcacagaagaaattgcagtgcaaaactggctagcaagagtggggcgtgagaggttatcaagaatggccatcagtggagatgattgtgttgtgaaacctttagatgacaggtttgcaagcgctctaacagctctaaatgacatgggaaaggttaggaaagacatacaacaatgggaaccttcaagaggatggaacgactggacacaagtgcctttttgttcacaccacttccatgagttaatcatgaaagacggtcgtgtactcgtagttccatgtagaaaccaagatgaactgattggtagagcccgaatttcacagggagccgggtggtctttgcgggagacggcctgtttggggaagtcttacgcccaaatgtggagcctgatgtacttccacagacgtgacctcaggctggcggcaaatgctatttgctcggcagtcccatcacattgggttccaacaagtcgaacaacctggtccatacacgccagacatgaatggatgacaacggaagacatgctgacagtctggaacagggtgtggattcaagaaaacccatggatggaagacaaaactccagtggaatcatgggaggaaatcccatacctggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 7109 - RNA, 9876 nt, synthetic construct
  misc_feature 1..9876: note = derived and/or modified CDS sequence (wt) from DENV-2__GQ398262__SS-prME
  source 1..9876: mol_type = other RNA
actgcaggcatgattatcatgttgattccaacagtgatggcgttccatttgaccacacgcaacggagaaccacacatgatcgtcagtagacaagagaaagggaaaagtcttctgtttaaaacagaggatggtgtgaacatgtgtaccctcatggccatggatcttggtgaattgtgtgaagacacaatcacttataattgtcctcttctcaggcagaatgaaccagaggacatagactgttggtgcaactccacgtccacatgggtaacttatgggacatgcaccgccacaggagaacacagaagggaaaaaagatcagtggcactcgttccacatgtgggaatgggactggagacacgaactgaaacatggatgtcatcagaaggggcctggaaacacgcccagagaattgaaacttggatcttgagacatccaggctttaccataatggcagcaatcttggcatacaccataggaacgacatactttcaaagagtcctgattttcatcttgctgacagctgtcgctccttcaatgacaatgcgttgtataggaatatcaaatagagactttgtggaaggggtttcaggaggaagctgggttgacatagtcttagaacatggaagctgtgtgacgacgatggcaaaaaataaaccaacattggattttgaactgataaaaacagaagccaaacaacccgctactctaaggaagtactgtatagaggcaaagctgaccaacacaacaacagcatctcgctgcccaacacaaggggaacccagcctaaatgaagagcaggacaaaaggttcgtctgcaaacattccatggtagacagaggatggggaaatggatgcggattatttggaaagggaggcatcgtgacctgtgctatgttcacatgcaaaaagaacatggaaggaaaagtcgtgcaaccagaaaacctggaatacaccattgtgataacaccccactcaggggaagagaatgcagtcggaaatgacacaggaaaacacggcaaggaaatcaaaataacaccacagagttccatcacagaagcagaactgacaggctatggcactgtcacgatggagtgctctccgagaacgggcctcgactttaatgagatggtgttgctgcaaatggaaaacaaagcttggctggtgcacagacaatggttcttagacctgccgttaccatggctgcccggagcggacacacaaggatcaaattggatacagaaggagacattggtcactttcaaaaatcctcatgcgaagaaacaggatgttgttgttttaggatcccaagaaggggctatgcatacagcacttacaggggccacggaaattcagatgtcatcaggaaacttactgttcacaggacatctcaagtgcaggctgagaatggacaaattacagctcaaaggaatgtcatattctatgtgtacaggaaagtttaaagttgtgaaggaaatagcagaaacacaacatggaacaatagttatcagagtacaatatgaaggggacggttctccatgcaagattccttttgagataatggatttggaaaaaagacatgtcttaggtcgcctgattacagtcaacccaattgttacagaaaaagacagcccagtcaacatagaagcagaacctccattcggagacagctacatcattataggagtagaaccgggacaactgaagctcaactggtttaagaaaggaagttctatcggtcaaatgtttgagacaacaatgagaggagcgaagagaatggccatcttaggtgacacagcctgggattttggatccctgggaggagtgttcacatctataggaaaggctctccaccaagtctttggagcaatttatggggctgccttcagtggggtctcatggactatgaaaatcctcataggagttgtcattacatggataggaatgaattcacgcagcacctcactgtctgtgtcactagtattagtgggagtcgtgacattgtatttgggagttatggtgcaggctgatagtggttgcgttgtgagttggaaaaacaaagaactgaaatgtggcagtgggatttttattacagacaacgtacacacatggacagaacaatacaaattccaaccagaatctccttcaaagctggcttcagctatccagaaagctcatgaagaaggcatttgtggaatccgctcagtaacaagactggagaatctgatgtggaaacaaataacaccagaactgaatcacattctatcagaaaatgaggtaaggttgactatcatgacaggagacattaaaggaatcatgcaggcaggaaaacgatccttgcggcctcagcccactgagctgaagtattcatggaaaacttggggcaaagcgaaaatgctctctacagagcttcataaccagacctttctcattgatggccccgaaacggcagaatgtcccaacacaaacagagcttggaactcactagaagttgaagactatggctttggagtattcaccaccaacatatggctgaaattgaaagaaaggcaggatgtattttgtgactcaaaacttatgtcagcggccataaaagacaacagagccgtccatgccgatatgggttattggatagaaagcgcacttaatgacacatggaagatagagaaagcctcttttatcgaagttaaaagctgccactggccaaagtcacatactctctggagtaatggagtgctagaaagcgagatgataattccaaagaattttgctggaccagtgtcacaacacaactacagaccaggctatcacacacaaacggcaggaccctggcatctaggtaagcttgagatggacttcaatttctgcgaaggaactacagtggtggtgactgaggactgtgggaatagaggaccctctttaagaacaactaccgcctctggaaaactcataacagaatggtgctgccgatcttgcacattaccaccgctaagatacagaggtgaggatggatgttggtacgggatggaaatcagaccattgaaagagaaagaagagaacttggtcaactctttggtcacagccggacatggacagattgacaacttctcactaggagtcttgggaatggcattgttcctggaagaaatgctcaggacccgagtaggaacgaaacatgcaatattactagttgcagtttctttcgtgacattgatcacagggaacatgtcctttcgagacctggggagagtgatggttatggtgggtgccactatgacggatgacataggcatgggcgtgacttatcttgccctactagcagccttcaaagttagaccaacttttgcagctggactactcttgagaaagctgacctccaaggaattgatgatgaccaccataggaatcgtactcctctctcagagcaccataccagagactatacttgaactgactgatgcgttggctctggggatgatggtcctcaaaatagtgagaaatatggaaaagtatcaattagcagtgactatcatggctatcttgtgcgtcccaaatgcagtgatactacaaaacgcatggaaagtgagttgcacaatactggcagtggtgtccgtctctccactgctcttaacatcctcacagcagaaagcggattggataccattggcattgacgatcaaaggcctcaatccaacagccattttcttaacaaccctttcaagaactagcaagaaaaggagctggccactaaatgaggctatcatggcagtcgggatggtgagcattttagccagttctctcttaaagaatgatattcccatgacaggaccactagtggctggagggcttctcactgtgtgttacgtgctcactggaagatcggccgatttggaactggagagggccgccgacgtgagatgggaagatcaggcagagatatcaggaagcagtccaattctgtcaataacaatatcggaagatggtagcatgtcgataaaaaatgaagaggaagaacaaacactgaccatactcattagaacaggactgctggtgatatcaggactttttcccgtatcaataccaatcacggcagcagcatggtacctgtgggaagtgaagaaacaacgggctggagtattgtgggatgtcccttcacccccacccgtgggaaaggccgaactggaagatggagcttatagaatcaagcagaaagggattcttggatactcccagatcggagccggagtttacaaagaaggaacattccacacgatgtggcacgttacacgtggtgctgttctaatgcataaagggaagagaattgaaccatcatgggcggacgtcaagaaagacctaatatcgtatggaggaggctggaagctagaaggagaatggaaggaaggagaagaagtccaggtcttggcattagagcctggaaagaatccaagagccgtccaaacaaaacccggtcttttcaaaactaacaccggaaccataggcgccgtgtctctggacttttctcctggaacgtcaggatctccaatcgtcgacaaaaaaggaaaagttgtgggtctttatggcaatggtgtcgtcacaaggagtggaacatatgtgagtgccatagcccagactgaaaaaagcattgaagacaatccagagattgaagatgacatctttcgaaagaaaagattgaccattatggacctccacccaggagcgggaaagacgaagagataccttccagcaatagtcagagaggctataaaacgaggcttgagaacattaatcctggcccccactagagtcgtggcagctgaaatggaggaagctcttagaggacttccaataagataccaaaccccagccatcagagctgagcatactgggcgggagattgtggatctaatgtgccacgccacatttaccatgaggctgctatcaccagttagagtgccaaattacaacctgatcatcatggatgaagcccacttcacagacccagcaagcatagcagctagaggatacatttcaactcgagtagagatgggtgaagcagctgggattttcatgacagccactcctccgggaagcagagacccatttcctcagagcaatgcaccaatcatggatgaagaaagggaaatccctgaacgttcgtggaattctggacatgagtgggttacggactttaaagggaagactgtttggtttgttccaagtataaaagcaggaaatgatatagcagcttgcctgagaaaaaatggaaagaaagtgatacaactcagtagaaagacctttgattctgaatatatcaagactaggaccaatgattgggacttcgtggtcacgactgatatttcagaaatgggtgccaacttcaaggctgagagggttatagaccccagacgctgcatgaaaccagtcatactaacagacggtgaagagcgggtgatcctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagctaagatgcttctagataacatcaacacgcctgaaggaattattcccagcatgttcgaaccagagcgtgaaaaggtggatgccattgatggtgaataccgcttaagaggagaagcgaggaaaacctttgtggacctaatgagaagaggagacctaccagtctggctggcctacagagtggcagctgaaggtatcaactacgcagacagaaggtggtgttttgatggaatcaagaacaaccaaatcttggaagaaaatgtggaagtggaaatttggacaaaagaaggggaaaggaagaaattaaaacccagatggttggatgctaggatctattctgacccgctggcgctcaaagaattcaaggaattcgcagctggaagaaagtccctgaccctgaatctaatcacagagatgggtaggcttccaactttcatgactcagaaagcaaggaacgcactggacaacttagcagtcctgcacacggctgaagcaggcggaagggcgtacaatcatgctcttagtgaactgccggagaccttggagacattgcttctactgacacttttggctacagtcacgggcggaatctttctattcttgatgagcggaaagggtatagggaaaatgaccctgggaatgtgctgcataatcacggccagtattcttctatggtacgcacaaatacaaccacactggatagcagcttcaataatactggagttttttctcatagtcttgcttattccagaaccagaaaagcagagaacaccccaagacaaccaattaacttacgttgtcatagccatcctcacagtggtggctgcaaccatggcaaacgagatgggtttcctggaaaaaacgaagaaagatttcggattgggaagcattgcaacccagcaacccgagagcaacatcctggacatagatctacgtcctgcatcagcatggactctgtatgccgtggccacaacattcatcacaccaatgttgagacatagcattgaaaattcctcagtgaatgtgtccctaacagccattgccaaccaagccacagtgttaatgggtcttgggaaaggatggccattgtcaaaaatggacatcggagttccccttctcgccattgggtgctattcacaagtcaaccccataactctcacagcagcccttcttttattagtagcacattatgctatcatagggccaggactccaagcgaaagcaaccagagaagctcagaaaagagcagcagcgggcatcatgaaaaacccaactgtagatggaataacagtgattgacctagatccaataccctatgacccaaagtttgaaaagcagttgggacaagtaatgctcctagtcctctgcgtgactcaagtattgatgatgaggactacatgggctttgtgtgaggctctaaccctagcgaccgggcccatctccacattgtgggaaggaaatccagggagattttggaatacaactattgcagtgtcaatggctaacatttttagagggagttacttggccggagctggactcctcttttctatcatgaagaacacagccaacacaagaaggggaactggcaacacaggagagacgcttggagagaaatggaaaaaccgattgaatgcattggggaagagtgaattccagatctataagaaaagtggaatccaggaagtggatagaaccttagcaaaagaaggcattaaaagaggagaaacggaccatcacgctgtgtcgcgaggctcagcaaaactgagatggttcgtcgagagaaacttggtcacaccagaggggaaagtagtggacctcggttgcggcagagggggctggtcatactattgtgggggactaaagaatgtaagagaagtcaaaggcctaacaaaaggaggaccaggacacgaagaacccattcccatgtcaacatatgggtggaatctggtgcgtcttcaaagtggagttgatgttttttttactccgccagaaaagtgtgacacattgctgtgtgacataggggagtcgtcaccaaatcccacggttgaagcaggacgaacactcagagtcttaaacctagtggaaaattggctgaacaacaacacccaattttgcataaaggttctcaacccatacatgccctcagtcatagaaaaaatggaagcgctacaaaggaaatacggaggagctttggtgaggaatccactctcacgaaattccacacatgagatgtactgggtttccaatgcttccgggaacatagtgtcatcagtgaacatgatttcaaggatgttgattaacagatttacaatgagacataagaaggccacatacgagccagatgttgacctcggaagcggaacccgcaacatcggaattgaaagtgagacaccaaacttagacataattggaaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttagactgctgacaaaaccttgggacgtcatccctatggtgacacagatggcaatgacagacacgactccatttggacaacagcgcgttttcaaagagaaagtggacacgagaacccaagaaccgaaagaaggcacgaagaaactaatgaaaatcacggcagaatggctctggaaagaactaggaaagaaaaagacacctaggatgtgcaccagagaagaattcacaagaaaggtgagaagcaatgcagccctaggtgccatattcactgatgagaacaagtggaagtcggcacgtgaggctgttgaagacagtagattttgggaactggttgacaaggaaaggaatctccatcttgaaggaaagtgtgaaacatgtgtgtacaacatgatgggaaagagagagaagaagctaggggagtttggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaagctaggctacattttaagagatgtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacggtaatggatattatatcgagaagagaccaaagaggtagtggacaagttggcacctatggtctcaatactttcaccaatatggaagcccaactaatcagacagatggagggagaaggagtcttcaaaagcatccagcacctgacagtcacagaagaaattgcagtgcaaaactggctagcaagagtggggcgtgagaggttatcaagaatggccatcagtggagatgattgtgttgtgaaacctttagatgacaggtttgcaagcgctctaacagctctaaatgacatgggaaaggttaggaaagacatacaacaatgggaaccttcaagaggatggaacgactggacacaagtgcctttttgttcacaccacttccatgagttaatcatgaaagacggtcgtgtactcgtagttccatgtagaaaccaagatgaactgattggtagagcccgaatttcccagggagccgggtggtctttgcgggagacggcctgtttggggaagtcttacgcccaaatgtggagcctgatgtacttccacagacgtgacctcaggctggcggcaaatgctatttgctcggcagtcccatcacattgggttccaacaagtcgaacaacctggtccatacacgccagacatgaatggatgacaacggaagacatgctgacagtctggaacagggtgtggattcaagaaaacccatggatggaagacaaaactccagtggaatcatgggaggaaatcccatacctggggaaaagagaagaccaatggtgcggctcattgattgggctaacaagcagggccacctgggcaaagaacatccaaacagcaataaatcaagttagatccctaataggcaatgaggaatatacagactacatgccatccatgaaaagattcagaagagaagaggaagaggcaggagtcctgtggtaa

SEQ ID NO: 7110 - RNA, 9876 nt, synthetic construct
  misc_feature 1..9876: note = derived and/or modified CDS sequence (wt) from DENV-2__GQ398261__SS-prME
  source 1..9876: mol_type = other RNA
actgcaggcatgattatcatgttgattccaacagtgatggcgttccatttgaccacacgcaacggagaaccacacatgatcgtcagtagacaagagaaagggaaaagtcttctgtttaaaacagaggatggtgtgaacatgtgtaccctcatggccatggatcttggtgaattgtgtgaagacacaatcacttataattgtcctcttctcaggcagaatgaaccagaagacatagactgttggtgcaactccacgtccacatggataacttatgggacatgcaccgccacaggagaacacagaagggaaaaaagatcagtggcactcgttccacatgtgggaatgggactggagacacgaactgaaacatggatgtcatcagaaggggcctggaaacacgcccagagaattgaaacttggatcttgagacatccaggctttaccataatggcagcaatcttggcatacaccataggaacgacatattttcaaagagtcctgattttcatcttgctgacagctgtcgctccttcaatgacaatgcgttgtataggaatatcaaatagagactttgtggaaggggtttcaggaggaagctgggttgacatagtcttagagcatggaagctgtgtgacgacgatggcaaaaaataaaccgacattggattttgaactgataaaaacagaagccaaacaacccgctactctaaggaagtattgtatagaggcaaagctgaccaacacaacaacagcatctcgctgcccaacacaaggggaacccagcctaaatgaagagcaggacaaaaggttcgtctgcaaacattccatggtagacagaggatggggaaatggatgcggattatttggaaagggaggcatcgtgacctgtgctatgttcacatgcaaaaagaacatggaaggaaaagtcgtgcaaccagaaaacttggaatacaccattgtgataacacctcactcaggggaagagaatgcagtcggaaatgacacaggaaaacacggcaaggaaatcaaaataacaccacagagttccatcacagaagcagaactgacaggctatggcactgtcacgatggagtgctctccgagaacgggcctcgacttcaatgagatggtgttgctgcaaatggaaaacaaagcttggctggtgcacagacaatggttcttagacctgccgttaccatggctgcccggagcggacacacaaggatcaaattggatacaaaaggagacattggtcactttcaaaaatcctcatgcgaagaaacaggatgttgttgtcttaggatcccaagaaggggctatgcatacagcacttacaggggccacggaaatccagatgtcatcaggaaacttactgttcacaggacacctcaagtgcaggctgagaatggacaaactacagctcaaaggaatgtcatattctatgtgtacaggaaagtttaaagttgtgaaggaaatagcagaaacacaacatggaacaatagttgtcagagtacaatatgaaggggacggttctccatgcaagatcccttttgagataatggatttggaaaaaagacatgtcttaggtcgcttgattacagtcaacccaattgttacagaaaaagacagcccagtcaacatagaagcagaacctccatttggagacagctacatcattataggagtagaaccgggacaactgaagctcaactggttcaagaaaggaagttctatcggccaaatgtttgagacaacaatgagaggagcgaagagaatggccattttaggtgacacagcctgggatttcggatccctgggaggagtgttcacatctataggaaaggctctccaccaagtttttggagcaatttatggggctgccttcagtggggtctcatggactatgaaaatcctcataggagttgtcattacatggataggaatgaattcacgcagcacctcactgtctgtgtcactagtattagtgggagtcgtgacattgtatttgggagttatggtgcaggccgatagtggttgcgttgtgagttggaaaaacaaagaactgaaatgtggcagtgggatttttgtcacagacaacgtacacacatggacagaacaatacaaattccaaccagaatctccttcaaagctggcttcagctatccagaaagctcatgaagaaggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccttgcggcctcagcccactgagctgaagtattcatggaaaacttggggcaaagcgaaaatgctctctacagagcttcataaccagacctttctcattgatggccccgaaacagcagaatgtcccaacacaaacagagcttggaactcactagaagttgaagactatggctttggagtattcaccaccaacatatggctgaaattgaaagaaaggcaggatgtattttgtgactcaaaactcatgtcagcggccataaaagacaacagagccgtccatgccgatatgggttattggatagaaagcgcactcaatgacacatggaagatagagaaagcctcttttatcgaagttaaaagctgccactggccgaagtcacatactctctggagtaatggagtgctagaaagcgagatgataattccaaagaattttgctggaccagtgtcacaacacaactacagaccaggctatcacacacaaacggcaggaccctggcatctaggtaagcttgagatggactttaatttctgcgaaggaactacagtggtggtgaccggggactgtgggaatagaggacccgctttaagaacaactaccgcctctggaaaactcataacagaatggtgctgccgatcttgcacattaccaccgctaagatacagaggtgaggatggatgttggtacgggatggaaatcagaccattgaaagagaaagaagagaacttggtcaactctttggtcacagccggacatggacagattgacaacttctcactaggagtcttgggaatggcattgttcctggaagaaatgctcaggacccgagtaggaacgaaacatgcaatattactagttgcagtttcttttgtgacattgatcacagggaacatgtcctttcgagacctggggagagtgatggttatggtgggtgccactatgacggatgacataggcatgggcgtgacttatcttgccctactagcagccttcaaagttagaccaacttttgcagctggactactcttgagaaagctgacctccaaggaattgatgatgaccaccataggaatcgtactcctctctcagagcaccataccagagactatacttgaactgactgatgcgttggctctggggatgatggtcctcaaaatagtgagaaatatggaaaagtatcaattagcagtgactatcatggctatcttgtgcgtcccaaatgcagtgatattacaaaacgcatggaaagtgagttgcacaatactggcagtggtgtccgtctctccactgctcttaacatcctcacagcagaaagcggattggataccattggcattgacgatcaaaggcctcaatccaacagccattttcttaacaaccctttcaagaactagcaagaaaaggagctggccactaaatgaggctatcatggcagtcgggatggtgagcattttagccagttctctcttaaagaatgatatccccatgacaggaccactagtggctggagggctcctcaccgtgtgttacgtgctcactggaagatcggccgatttggaactggagagggccgccgacgtgagatgggaagatcaggcagagatatcaggaagcagtccaattctgtcaataacaatatcggaagatggtagcatgtcgataaaaaatgaagaggaagaacaaacactgaccatactcattagaacaggactgctggtgatatcaggactttttcccgtatcaataccaatcacggcagcagcatggtacctgtgggaagtgaagaaacaacgggctggagtattgtgggatgtcccttcacccccacccgtgggaaaggccgaactggaagatggagcttatagaatcaagcagaaagggattcttggatactcccagatcggagccggagtttacaaagaaggaacattccacacgatgtggcacgttacacgtggtgctgttctaatgcataaagggaagagaattgaaccatcatgggcggacgtcaagaaagacctaatatcgtatggaggaggctggaagctagaaggagaatggaaggaaggagaagaagtccaggtcttggcattagagcctggaaagaatccaagagccgtccaaacaaaacccggtcttttcaaaactaacaccggaaccataggcgccgtgtctctggacttttctcctggaacgtcaggatctccaatcgtcgacaaaaaaggaaaagtcgtgggcctttatggcaatggtgtcgtcacaaggagtggaacatatgtgagtgccatagcccagactgaaaaaagcattgaagacaatccagagattgaagatgacatctttcgaaagaaaagattgaccattatggacctccacccaggagcgggaaagacgaagagataccttccagcaatagtcagagaggctataaaacgaggcttgagaacattaatcctggcccccactagagtcgtggcagctgaaatggaggaagctcttagaggacttccaataagataccaaaccccagccatcagagctgagcacactgggcgggagattgtggatctaatgtgccacgccacttttaccatgaggctgctatcaccagttagagtgccaaattacaacctgatcatcatggatgaagcccatttcacagacccagcaagcatagcagctagaggatacatttcaactcgagtagagatgggtgaagcagctgggattttcatgacagccactcctccgggaagcagagacccatttcctcagagcaatgcaccaatcatggatgaagaaagggaaatccctgaacgttcgtggaattctggacatgagtgggttacggactttaaagggaagactgtttggtttgttccaagtataaaagcaggaaatgatatagcagcttgcctgagaaaaaatggaaagaaagtgatacaactcagtagaaagacctttgattctgaatatatcaagactaggaccaatgattgggacttcgtggtcacgactgacatttcagaaatgggtgctaacttcaaggctgagagggttatagaccccagacgctgcatgaaaccagtcatactaacagacggtgaagagcgggtgatcctggcaggacccatgccagtgacccactctagtgcagcacaaagaagagggagaataggaagaaatccaaaaaatgaaaatgaccagtacatatacatgggggaacctctggaaaatgatgaagactgtgcacattggaaagaagctaagatgcttctagataacatcaacacgcctgaaggaatcattcccagcatgttcgaaccagagcgtgaaaaggtggatgccattgatggtgaataccgcttaagaggagaagcgaggaaaacctttgtggacctaatgagaagaggagacctaccagtctggctggcctacagagtggcagctgaaggtatcaactacgcagacagaaggtggtgttttgatggaatcaagaacaaccaaatcttggaagaaaatgtggaagtggaaatttggacaaaagaaggggaaaggaagaaattaaaacccagatggttggatgctaggatctattctgacccgctggcgctcaaagaattcaaggaattcgcagctggaagaaagtccctgaccctgaatctaatcacagagataggtaggcttccaactttcatgactcagaaagcaaggaacgcactggacaacttagcagtcctgcatacggctgaagcaggcggaagggcatacaatcatgctcttagtgaattgccggagaccctggagacattgcttttactgacacttttggctacagtcacgggcggaatctttctattcttgatgagcggaaagggtatagggaaaatgaccctgggaatgtgctgcataatcacggccagtattctcctatggtacgcacaaatacaaccacactggatagcagcttcaataatactggagttttttctcatagtcttgcttattccagaaccagaaaagcagagaacaccccaagacaaccaattaacttacgttgtcatagccatcctcacagtggtagctgcaaccatggcaaacgagatgggtttcctggaaaaaacgaagaaagatttcggattgggaagcattgcaacccagcaacccgagagcaacatcctggacatagatctacgtcctgcatcagcatggactctgtatgccgtggccacaacattcatcacaccaatgttgagacatagcattgaaaattcttcagtgaatgtttccctaacagctattgccaaccaagccacagtgttaatgggtcttgggaaaggatggccattgtcaaaaatggacatcggagttccccttctcgccatcgggtgctattcacaagtcaaccccataactctcacagcagcccttcttttattggtagcacattatgctatcatagggccaggactccaagcgaaagcaaccagagaagctcagaaaagagcagcagcgggcatcatgaaaaacccaactgtagatggaataacagtgattgacctagatccaataccctatgatccaaagtttgagaagcagttgggacaagtaatgctcctagtcctctgcgtgactcaagtattgatgatgaggactacatgggctttgtgtgaggctctaaccctagcgaccgggcccatctccacattgtgggaaggaaatccagggagattttggaatacaactattgcagtgtcaatggctaacatttttagagggagttacttggccggagctggactcctcttttctatcatgaagaatacagccaacacaagaaggggaactggcaacacaggagagacgcttggagagaaatggaaaaaccgattgaatgcattggggaagagtgaattccagatctataagaaaagtggaattcaggaagtggatagaaccttagcaaaagaaggcattaaaagaggagaaacggaccatcacgctgtgtcgcgaggctcagcaaaactgagatggttcgtcgagagaaacctggtcacaccagaggggaaagtagtggacctcggttgcggcagagggggctggtcatactattgtgggggactaaagaatgtaagagaagtcaaaggcctaacaaaaggaggaccaggacacgaagaacccattcccatgtcaacatatgggtggaatctggtgcgtcttcaaagtggagttgatgttttttttactccgccagaaaagtgtgacacattgctgtgtgacataggggagtcgtcaccaaatcccacgattgaagcaggacgaacactcagagtcttaaacttagtggaaaattggctgaacaacaacacccaattttgtataaaggttctcaacccatacatgccctcagtcatagaaaaaatggaagcgctacaaaggaaatacggaggagctttggtgaggaatccactctcacgaaattccacacatgagatgtactgggtttccaatgcttccgggaacatagtgtcatcagtgaacatgatttcaaggatgttgattaacagatttacaatgagacataagaaggccacatacgagccagatgttgacctcggaagcggaacccgcaacatcggaattgaaagtgagacaccaaacttagacataattggaaaaagaatagaaaaaataaaacaagagcatgaaacatcatggcactatgaccaagaccacccatacaaaacgtgggcctaccatggcagctacgaaacaaaacagaccggatcagcatcatccatggtgaacggagtagtcagattgctgacaaaaccttgggacgtcatccctacggtaacacagatggcaatgacagacacgactccatttggacaacagcgcgttttcaaagagaaagtggacacgagaacccaagaaccgaaagaaggcacgaagaaactaatgaaaatcacggcagaatggctctggaaagaactaggaaagaaaaagacacctaggatgtgcaccagagaagaattcacaagaaaggtgagaagcaatgcagccctaggtgccatattcactgatgagaacaagtggaagtcggcacgtgaggctgttgaagacagtagattttgggaactggttgacaaggaaaggaatctccatcttgaaggaaagtgtgaaacatgtgtgtacaacatgatgggaaagagagagaagaagctaggggagtttggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaagctaggctacattttaagagatgtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacggtaatggatattatatcgagaagagaccaaagaggtagtggacaagttggcacctatggtctcaatactttcaccaatatggaagcccaactaatcagacagatggagggagaaggagtcttcaaaagcatccagcacctgacagtcacagaagaaattgcagtgcaaaactggctagcaagagtggggcgtgagaggttatcaagaatggccatcagtggagatgattgtgttgtgaaacctttagatgacaggtttgcaagcgctctaacagctctaaatgacatgggaaaggttaggaaagacatacaacaatgggaaccttcaagaggatggaacgactggacacaagtgcctttttgttcacaccacttccatgagttaatcatgaaagacggtcgtgtactcgtagttccatgtagaaaccaagatgaactgattggtagagcccgaatttcacagggagccgggtggtctttgcgggagacggcctgtttggggaagtcttacgcccaaatgtggagcctgatgtacttccacagacgtgacctcaggctggcggcaaatgctatttgctcggcagtcccatcacattgggttccaacaagtcgaacaacctggtccatacacgccagacatgaatggatgacaacggaagacatgctgacagtctggaacagggtgtggattcaagaaaacccatggatggaagacaaaactccagtggaatcatgggaggaaatcccatacctggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 7111 - RNA, 9876 nt, synthetic construct
  misc_feature 1..9876: note = derived and/or modified CDS sequence (wt) from DENV-2__GQ398313__SS-prME
  source 1..9876: mol_type = other RNA
acagcaggcgtgattattatgttgattccaacagcgatggcattccatttaaccacacgtaatggagaaccacacatgatcgttggtaggcaagagaaagggaaaagtcttctgttcaaaacagaggacggtgttaacatgtgtaccctcatggccatagaccttggtgaattgtgtgaagatacaattacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggttttaccataatggcagcaatcctggcatacaccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagttaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaagacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgcagtatcctttgtgacattgattactgggaacatgtcctttagagacctgggaagagtgatggttatggtgggcgccaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgcttttaacatcctcacagcagaaagcggattggataccactggcattgacgataaaaggtctcaatccaacagccatttttctaacaactctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtgaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcaataccaattacggcagcagcatggtacttgtgggaagtgaagaaacaacgggctggagtattgtgggacgtcccttcacccccaccagtgggaaaggccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggcagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacctagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtaactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacttaggaagcggaacccgcaacattggaattgaaagtgagataccaaacctagatataataggaaagagaatagagaaaataaagcaagagcatgaaacatcatggcactatgaccaagaccacccatacaaaacgtgggcttaccatggcagctacgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaagacacctaggatgtgcaccagagaagaatttacaagaaaggtgagaagcaacgcagccttgggggccatattcactgatgagaacaaatggaaatcggcacgtgaggctgttgaagatagcaggttttgggagctgattgacagggaaagaaatctccatcttgaaggaaagtgtgaaacatgcgtgtacaacatgatgggaaaaagagagaagaaactaggggagttcggcaaggcaaagggtagcagagccatatggtacatgtggcttggagcacgcttcctagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaatgattggacacaagtgcctttctgttcacaccattttcatgagttagtcatgaaagatggccgcgtgctcgtagtcccatgcagaaaccaagacgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 7112 - RNA, 9876 nt, synthetic construct
  misc_feature 1..9876: note = derived and/or modified CDS sequence (wt) from DENV-2__GQ398285__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcactcgttccacatgtgggtatgggactagagacacgaactgaaacatggatgtcatcagaaggggcctggaaacatgttcagagaattgaaacctggatcctgagacatccaggctttaccataatggcagcaatcctggcatacaccataggaacaacacatttccaaagggccttgattttcatcctactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaatgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggacgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacccccattcggagacagctacattatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggaacaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactggcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggaggcattaaaggaatcatgcaggcaggaaaacgatctttgaggccccagcccactgagctgaagtactcatggaaaacatggggaaaggcgaaaatgctctccacagaatctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagcgagatgataattccaaaaaatttagccgggccagtgtcacaacacaattacagaccaggctaccacacacaaacagcaggaccttggcatctaggtaagcttgagatggactttgatttctgtgaaggaaccacagtggtggtgactgaggactgtggaaatagaggaccctctttaagaacgaccactgcctctggaaaactcgtaacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagagcaaacactgactatactcatcagaacgggattgttggtgatctcaggagtctttccagtatcaataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaggtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatacgtgagtgctatagcccagaccgaaaaaagcattgaagacaatccagagatcgaagatgacattttccgaaagaaaagattgaccatcatggacctccatccaggagcaggaaagacaaaaagatatcttccagccatagttagagaagccataaaacgtggcttgagaacattaatcctggctcccactagagtcgtggcagctgaaatggaggaagctcttagaggacttccaataagataccaaaccccagccattagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcgccaatcatggatgaggaaagagaaatccctgagcgttcgtggaattcaggacatgaatgggtcacggattttaaagggaagactgtatggttcgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacccatgccagtgacccactctagtgcagcgcaaagaagagggagaataggaagaaatccaaaaaatgaaaatgaccagtacatatatatgggggaacccctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacttttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaactaaaacccagatggttggatgctaggatctattctgacccactggcactaaaagaattcaaggaatttgcagctggaagaaaatccttgaccctgaacctaatcacagaaatgggtaggcttccaactttcatgactcagaaggcaagaaacgcactggacaatttagctgtgctgcatacggctgaggcaggtggaagggcgtacaatcatgctctcagtgaactgccggagaccctggagacactgcttttactgacactcctggccacagtcacaggaggaatctttttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctctctaacagctattgctaaccaagccacagtgctaatgggtcttgggaaaggatggccattgtcaaagatggacatcggagttcccctccttgccattggatgctactcacaagtcaaccctataaccctcacagcagcccttcttttattagtagcacattatgccattatagggccaggacttcaagcaaaagcaaccagagaagctcagaaaagagcagcagcaggcatcatgaaaaacccaacggttgatggaataacagtgattgacctagaaccaataccctacgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaacccactctcacgaaactccacacatgagatgtactgggtatccaatgctaccgggaacatagtgtcatcagtgaatatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagatcacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggatacgagaactcaagaaccgaaggaaggcacaaagaaactgatgaaaattacggcagagtggctttggaaagaactaggaaaggaaaagacacccaggatgtgtaccagagaagaatttgcaagaaaggtgagaagcaatgcagccttgggggccatattcactgatgagaacaaatggaaatcggcacgcgaggctgttgaagatagtaggttttgggagctgattgacagggaaagaaatctccatcttgaaggaaagtgtgaaacatgtgtgtacaacatgatgggaaaaagagagaagaaactaggggagttcggtaaggcaaaaggtagcagagccatatggtacatgtggcttggagcacgcttcttagagtttgaagccctaggattcttgaatgaagatcactggttctccagagagaactccctgagtggagtggaaggagaggggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagcagaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagccacagaagaaatcgctgtacagaactggttagcaagagtggggcgtgaaaggctatcaagaatggccatcagtggagatgattgtgttgtaaaacctttggatgacagatttgcaagtgctttaacagccctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaaatcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaatccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcttgtggtag

SEQ ID NO: 7113 - RNA, 9876 nt, synthetic construct
  misc_feature 1..9876: note = derived and/or modified CDS sequence (wt) from DENV-2__GQ398298__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacatgtgggtatgggactggagacacgaactgaaacatggatgtcatcggaaggggcctggaaacatgttcagagaattgaaacctggatcttgagacatccaggctttaccataatggcagcaatcctggcatacaccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcattatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtgacaagattggagaatctgatgtggaaacaaataacaccagaattgaatcatattctatcagaaaatgaggtaaagttgaccattatgacaggagacatcaaaggaatcatgcaggcaggaaaacgatctttgaggccccagcccactgagctgaagtactcatggaagacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggactcttgggaatggcactgttcctggaagaaatgctcaggacccgagtaggaacgaagcatgcaatgctgctagttgtagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcactataccagagaccattcttgaattgactgacgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcaataccaatcacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacatcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggattttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctggataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaggaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattgcaacccaggaatctgagagcaacatcctggacatagatctacgtcctgcatcagcatggacgctgtatgccgtggctacaacatttgtcacaccaatgttgagacacagcattgaaaattcctcagtgaatgtctccctaacagctatagctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccggaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacttaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggatacgagaacccaagaaccgaaggaaggcacaaagaaactgatgaaaatcacggcagagtggctctggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcctagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 7114 - RNA, 9876 nt, synthetic construct
  misc_feature 1..9876: note = derived and/or modified CDS sequence (wt) from DENV-2__GQ398301__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggtgaacacagaagagaaaaaagatcagtggcactcgttccacatgtgggtatgggactggagacacgaactgaaacatggatgtcatcggaaggggcctggaaacatgttcagagaattgaaacctggatcttgagacatccaggctttaccataatggcagcaatcctggcatacaccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtgacaagattggagaatctgatgtggaaacaaataacaccagaattgaatcacattctatcagaaaatgaggtaaagttgaccattatgacaggagacatcaaaggaatcatgcaggcaggaaaacgatctttgaggccccagcccactgagctgaagtactcatggaagacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgcagcatcctttgtgacattgattactgggaacatgtcctttagagacctgggaagagtgatggttatggtgggcgctaccatgacggatgacataggtatgggaataacttatcttgctctactagcagctttcaaagtcaggccaacttttgcagctggactactcttgagaaaactgacctccaaggaattaatgatggccaccataggaatcgcactcctttcccaaagcaccataccagagaccattcttgaactgactgacgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaggccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacttaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggattttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctggataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaatcaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctatagctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccggaagggaaggtggtggacctcggttgtggcagagggggttggtcatactattgtgggggactaaagaatgtaagagaagtcaaaggcctgacaaaaggaggaccaggacacgaagaacccatccccatgtcaacgtatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacttaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgtcttcaaagagaaagtggacacgagaacccaagaaccgaaggaaggcacaaagaaactgatgaaaatcacggcagagtggctctggaaagaactaggaaaggaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaacgaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 7115 - RNA, 9876 nt, synthetic construct
  misc_feature 1..9876: note = derived and/or modified CDS sequence (wt) from DENV-2__GQ398312__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacatgtgggtatgggactggagacacgaactgaaacatggatgtcatcagaaggggcctggaaacatgttcagagaatcgaaacctggatcttgagacatccaggctttaccataatggcagcaatcctggcatacaccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttggaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaagacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaaacttgagatggactttgatttctgcgaaggaaccacagtggtggtgactgaggactgtggaaatagaggaccctctttaagaacgaccactgcctctggaaaactcataacagaatggtgctgtcgatcctgtacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgcagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctgggaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccattccctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtagcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctgatgggtcttgggaaaggatggccattgtcaaagatggacatcggagttcccctccttgccattggatgctactcacaagtcaaccctataactctcatagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcagagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacttaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctacgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 7116 - RNA, 9876 nt, synthetic construct
  misc_feature 1..9876: note = derived and/or modified CDS sequence (wt) from DENV-2__GQ398289__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaagatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcgtcagaaggggcctggaaacatgttcagagaattgaaacctggatcttgagacatccaggctttgccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacccaacatggaacaatagttatcagagtacaatatgaaggggatggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgtgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaactgaatcacattctatcagaaaatgaggtaaagttgaccattatgacaggagacactaaaggaatcatgcaggcaggaaaacgatctttgaggccccagcccactgagctgaagtactcatggaaaacatggggaaaggcaaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtgggaacgaaacatgcaatactgctaattgcagtatcttttgtgacattgattactgggaacatgtcctttagagacctgggaagagtgatggttatggtgggcgctaccatgacggatgacataggtatgggagtgacttatcttgccctactagcagctttcaaagtcagaccaacttttgcagctggactactcttgagaaaactgacttccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggccatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgctggtgatctcaggagtctttccagtatcaataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctgggaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctctacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacacagggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagccaaaatgcttctagataacatcaacacacctgaaggaatcattcctagtctgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacttaatcacagaaatgggtaggcttccaactttcatgactcagaaggcaagagacgcactggacaacttagctgtgctgcatacggctgaggcaggtggaagggcatacaatcatgctctcagtgaactgccggagaccctggagacactgcttttactgacactcctggccacagtcacaggaggaatcttcttattcttaatgagcggaagaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcttcagtgaatgtctccctaacagctattgctaaccaagccacagtgctgatgggtcttgggaaaggatggccattgtcaaagatggacatcggagttcccctccttgccattggatgctactcacaagtcaaccctataaccctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggactcctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaaccaatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacggacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatctaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataatagggaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagaaggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagttacagaagaaatcgctgtacagaactggttagcaagagtgggacgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcaggctggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 7117 - RNA, 9876 nt, synthetic construct
  misc_feature 1..9876: note = derived and/or modified CDS sequence (wt) from DENV-2__GQ398290__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagagaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattgtttggaaagggaggcattgtgacctgtgctatgtttacatgcaaaaagaacatggaaggaaaagtcgtgctgccagaaaattttgaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgttgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcgggaaacttactgttcacaggacatctcaagtgcaggctgagaatggacaaactacagctcaaaggaatgtcatactctatgtgtacaggaaagtttaaaattgtgaaggaaatagcagaaacccaacatggaacaatagttatcagagtacaatatgaaggggatggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgtgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatctctgcgaaggaaccacagtggtggtgactgagaactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacttccaaggaattaatgatggccaccataggaattgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgttccttcacccccgccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagctataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgactgggactttgtggtcacaaccgacatttcagaaatgggtgccaacttcaaggctgagagggttatagaccccagacgttgcatgaaaccagtaatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcatacaatcatgctctcagtgaactgccggagaccctggagacactgcttttactgacactcctggccacagtcacaggaggaatcttcttattcttaatgagcggaagaggcataggaaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggccacaacattcgtcacaccaatgttgagacatagcattgaaaattcttcagtgaatgtctccctaacagctattgctaaccaagccacagtgctgatgggtcttgggaaaggatggccattgtcaaagatggacatcggagttcccctccttgccattggatgctactcacaagtcaaccctataaccctcacagcagcccttcttttattggtagcacattatgccattatagggccaggacttcaagcaaaagcaaccagagaagctcagaaaagagcagcagcaggcatcatgaaaaacccaacagtcgatggaataacagtaattgacctagaaccaataccctatgatccaaaatttgaaaagcagttaggacaagtaatgctcctaattctctgcgtgactcaagtattaatgatgaggaccacatgggctctgtgtgaggccctaactctagcgaccgggcccatctccacactgtgggaaggaaatccagggaggttttggaacactaccattgcagtgtcaatggctaatatctttagggggagctacttggccggagctggactcctcttttccatcatgaagaacacaacaaacacaagaagaggaactggcaacataggagagacactcggagaaaaatggaagagccgattaaacacactggggaaaagtgaatttcagatctacaagaaaagtggaatccaggaagtggatagaaccttagcaaaagaaggtatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatacatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgatcaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccattcggacaacaacgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcgggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagccacagaagaaatcgctgtacagaactggttagcaagagtggggcgtgaaaggctatcaagaatggccatcagtggagatgattgtgttgtaaaacctttggatgacagatttgcaagtgccttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcaggctggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacctggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 7118 - RNA, 9876 nt, synthetic construct
  misc_feature 1..9876: note = derived and/or modified CDS sequence (wt) from DENV-2__GQ398284__SS-prME
  source 1..9876: mol_type = other RNA
acagcaggcgtgattattatgttgattccaacagcgatggcgttccatctaaccacacgtaacggagaaccacacatgatcgttggtaagcaagagaaagggaaaagtcttctgttcaaaacagaggatggtgttaacatgtgcaccctcatggccatagaccttggtgaattgtgtgaagatacaatcacgtacaagtgtcccctcctcagacaaaatgaaccagaagacatagactgttggtgcaactccacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgatcttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacactggattttgaactgataaaaacagaagccaaacaacctgccactctaaggaagtactgtatagaagcaaaactgaccaacacaacaacagaatctcgttgcccaacacaaggggaacccagtctgaatgaagagcaggacaaaaggttcctctgcaaacactccatggtagatagaggatggggaaatggatgtggattatttggaaagggaggcattgtgacctgtgctatgtttacatgcaagaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgttgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgctttaggatctcaagaaggggccatgcacacggcactcacaggggccacagaaatccagatgtcatcaggaaacctactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggatggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatagggctgcttttagtggggtctcatggactatgaaaatcctcataggagtcatcatcacatggataggaatgaattcacgtagcacctcactgtctgtgtcactggtattggtgggagtcgtgacactgtacctgggagctatggtgcaggctgatagtggttgcgttgtgagctggaaaaataaagaactgaaatgtggcagcgggatctttatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagattatggttttggagtttttaccaccaatatatggctaaaattgagagaaaaacaggatgtattttgtgactcaaaactcatgtcagccgccataaaagacaacagagccgtccatgccgatatgggttattggatagaaagtgcactcaatgacacatggaagatggagaaagcctctttcattgaagttaaaagctgtcactggccaaagtcacacaccctctggagcaatggagtattagaaagcgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccctggtcacagccggacatgggcagattgacaacttttcactaggagtcttgggaatggcactgttcctggaagaaatgctcaggacccgagtgggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccatagggatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttccccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagttgggatggtgagcattttagccagttctctcctaaagaatgacattcccatgacaggtccattagtggctggagggctccttactgtgtgttacgtgctcactggacgatcggccgatttggaactggagagagctgccgacgtgaaatgggaagatcaggcagaaatatcaggaagcagcccaatcctgtcaataacaatatcagaagatggcagcatgtcaatcaaaaatgaagaggaagaacaaacactgaccatactcatcagaacgggattgttggtgatctcaggagtctttccggtatcaataccaatcacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaggtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgccatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccattagagccgagcacactgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggagccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagataacattaacacacctgaaggaatcattcctagtatgttcgaaccagagcgtgaaaaggtggatgccattgatggtgaataccgtttaagaggagaagcaaggaaaacctttgtggacctaatgagaagaggggacttaccagtctggctggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctagaatctattctgacccactggcactaaaagaattcaaggaatttgcagctggaagaaaatctttgaccctgaacctaatcacagaaatgggtaggcttccaactttcatgactcagaaggcaagagacgcactggacaacttagccgtactgcacacggctgaggcaggtggaaaggcatacaatcatgctctcagtgaactgccggagaccctggagacactgcttttgctgacactcctggccacagtcacaggaggaatcttcttattcttaatgagcggaaaaggtatagggaagatgaccctgggaatgtgttgcataatcacggctagtatcctcctatggtatgcacaaatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctaggattgggaagcattataacccaggaatccgagagcaacatcctggacatagatctacgtcctgcatcagcatggacgctgtatgccgtggctacaacatttgtcacaccaatgttgagacatagcattgaaaattcctcagttaatgtctccctaacagccattgctaaccaagccacagtgctaatgggtcttgggaaaggatggccattgtcaaagatggacatcggagttcccctccttgccattggatgctactcacaagtcaaccccataactctcacagcagctcttcttttgttggtagcacattatgccattatagggccaggacttcaagcaaaagcaaccagagaagctcagaaaagagcagcagcaggcatcatgaaaaacccaacagttgatggaataacagtgattgacctagaaccaataccctatgatccaaaatttgaaaagcagttaggacaagtaatgctcctaatcctctgcgtgactcaagtattaatgatgaggactacatgggctctgtgtgaggctttaactttagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaaaaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgcgggggattaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggttctcaacccatatatgccctcagtcatagaaaaaatggaaacactacaaaggaaatatggaggagccttagtgaggaatccactctcgcgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaattcacaagaaaggtgagaagcaatgcagccttgggggccatattcactgatgagaacaaatggaagtcggcacgtgaggctgttgaggatagtaggttttgggagctggttgacagggaaagaaatctccatcttgaaggaaagtgtgaaacatgtgtgtacaacatgatgggcaaaagagagaagaaactaggggagttcggaaaggcaaaaggtagcagagccatatggtacatgtggcttggagcacgcttcttagagtttgaagccctaggattcttgaatgaagatcattggttctccagagggaactccctgagtggagtggaaggagaagggttgcacaggctaggctacattttaagagacgtgagcaagaaggaagggggagcaatgtatgccgatgatacagcaggatgggacacaagaatcacactagaagacctaaaaaatgaagaaatggtaacaaaccacatgaaaggagaacacaagaaactagccgaggccatattcaaattaacgtaccaaaacaaggtggtgcgtgtgcaaagaccaacgccaagaggcacagtaatggatatcatatcgagaagagaccaaagaggcagtgggcaagtcggcacctatggccttaatactttcaccaacatggaagcccaattaattagacagatggaaggagaaggaatcttcaaaagcattcagcacctgacagttacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacgacttggtccatacacgctaaccatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcttgtggtag

SEQ ID NO: 7119 - RNA, 9876 nt, synthetic construct
  misc_feature 1..9876: note = derived and/or modified CDS sequence (wt) from DENV-2__GQ398308__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggctttgattttcatcttactgacggctgtcgctccttcaatgacaatgcgttgcataggaatatcaaatagagacttcgtagaaggggtttcaggaggaagctgggttgacatagtcttggaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacattgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaagcgatctttgaggccccagcccactgagctgaagtactcatggaagacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggctataaaagacaacagagccgtccatgccgacatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaaacttgagatggactttgatttctgcgaaggaaccacagtggtggtgactgaggactgtggaaatagaggaccctctttaagaacgaccactgcctctggaaaactcataacagaatggtgctgtcgatcctgtacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgcagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagccatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaatcacggcagcagcatggtacttgtgggaagtgaagaaacaacgggctggagtattgtgggacgtcccttcacccccaccagtgggaaaggccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggtaatggtgttgtcacaaggagtggagcatatgtgagtgctatagcccagaccgaaaaaagcattgaagacaatccagaaatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggatgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctcggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctagccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaatgacacccaattttgcataaaggttctcaacccatatatgccctcagtcatagaaaaaatggaaacactacaaaggaaatatggaggagccatagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacttaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctacgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagtattcagcacctgacagtcacagaagaaatcgctgtacagaactggttagcaagagtggggcgtgaaaggctatcaagaatggctatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctgacagtctggaatagggtgtggatccaggaaaacccgtggatggaagacaaaactcctgtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 7120 - RNA, 9876 nt, synthetic construct
  misc_feature 1..9876: note = derived and/or modified CDS sequence (wt) from DENV-2__GQ398287__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcgtcagaaggggcctggaaacatgttcagagaattgaaacctggatcttgagacatccaggctttgccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttgggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacccaacatggaacaatagttatcagagtacaatatgaaggggatggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgtgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcaaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctttggagcaatggagtattggaaagtgagatgataattccaaaaaatcttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgagtgggaacgaaacatgcaatactgctaattgcagtatcttttgtgacattgattactgggaacatgtcctttagagacctgggaagagtgatggttatggtgggcgctaccatgacggatgacataggtatgggagtgacttatcttgccctactagcagctttcaaagtcagaccaacttttgcagctggactactcttgagaaaactgacttccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggccatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgctggtgatctcaggagtctttccagtatcgataccaattacggcagcagcatggtacctgtgggaagtgaagaaacaacgggctggagtattgtgggacgtcccttcacccccaccagtggaaaaagccgaactggaagatggagcctatagaatcaagcaaagagggattcttggatactctcagattggagctggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctgggaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctctacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacacagggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagccaaaatgcttctagacaacatcaacacacctgaaggaatcattcctagtctgttcgaaccagagcgtgaaaaagtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcatacaatcatgctctcagtgaactgccggagaccctggagacactgcttttactgacactcctagccacagtcacaggaggaatcttcttattcttaatgagcggaagaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcttcagtgaatgtctccctaacagctattgctaaccaagccacagtgctgatgggtcttgggaaaggatggccattgtcaaagatggacatcggagttcccctccttgccattggatgctactcacaagtcaaccctataaccctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggactcctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgtgttcttcaccccgccagaaaagtgtgatacagtgttgtgtgacataggggagtcgtcaccaaatcccacgatagaagcaggacggacgcttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatctaatgctaccgggaacatagtgtcatcagtgaacatgatttcaaggatgttgattaacagattcacaatgaagcacaagaaagccacctacgagccagatgttgacctaggaagcggaacccgcaacattggaattgaaagtgagataccaaacctagacataatagggaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactgggggagttcggcaaggcaaaaggtagcagagccatatggtacatgtggcttggagcacgcttcttagagtttgaagccctaggattcttgaatgaagatcactggttctccagaaggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagttacagaagaaatcgctgtacagaactggttagcaagagtggggcgtgaaaggctatcaagaatggccatcagtggagatgattgtgttgtaaaacctttggatgacagatttgcaagtgctttaacagctctaaatgatatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcaggctggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 7121 - RNA, 9876 nt, synthetic construct
  misc_feature 1..9876: note = derived and/or modified CDS sequence (wt) from DENV-2__GQ398302__SS-prME
  source 1..9876: mol_type = other RNA
acagcaggcgtgattattatgttgattccaacagcgatggcgttccatttaaccacacgtaatggagaaccacacatgatcgttagtaggcaagagaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacatgtgggtatgggactggagacacgaactgaaacatggatgtcatcggaaggggcctggaaacatgttcagagaattgaaacctggatcttgagacatccaggctttaccataatggcagcaatcctggcatacaccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaacacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgttcacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtgacaagattggagaatctgatgtggaaacaaataacaccagaattgaatcacattctatcagaaaatgaggtaaagttgaccattatgacaggagacatcaaaggaatcatgcaggcaggaaaacgatctttgaggccccagcccactgagctgaagtactcatggaagacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgcgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaagaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgcagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattgatgatggccaccataggaatcgcactcctttcccaaagcaccataccagagaccattcttgaactgactgacgcgttagccttgggcatgatggtcctcaaaatagtgagaaatatggaaaagtaccaattggcagtgactattatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctcttctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaggccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcgtatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggattttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctggataacatcaacacacctgaaggaatcattcctagtatgttcgaaccagagcgtgaaaaggtggatgccatcgatggtgaatatcgtttgagaggagaagcaaggaaaacctttgtggacctaatgagaagaggggacttaccagtctggttggcctacagagtggcagctgaaggcatcaactacgcagacagaaggtggtgttttgatggaattaagaacaatcaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagtcttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctatagctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccggaagggaaggtggtggacctcggttgtggcagagggggttggtcatactattgtgggggactaaagaatgtaagagaagtcaaaggcctgacaaaaggaggaccaggacacgaagaacccatccccatgtcaacgtatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacttaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaacgaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgatagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccttggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 7122 - RNA, 9876 nt, synthetic construct
  misc_feature 1..9876: note = derived and/or modified CDS sequence (wt) from DENV-2__GQ398272__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggacggatgctggtacgggatggaaatcagaccattgaaagagaaagaggagaatttggtcaactccttggtcacagccggacatgggcagattgacaacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagggggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcatagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgatcaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggcctcaatactttcaccaacatggaagcccaattaattagacagatggagggagaaggaatttttaaaagcattcagcacctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 7123 - RNA, 9876 nt, synthetic construct
  misc_feature 1..9876: note = derived and/or modified CDS sequence (wt) from DENV-2__GQ398292__SS-prME
  source 1..9876: mol_type = other RNA
acagcaggcgtgtttattatgttgattccaacagcaatggcgttccatttaaccacacgtaatggagaaccacacatgatcgttggtaggcaagagaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcatgagacatccaggctttaccataatggcagcaatcctggcatacaccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaagattcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgcggcagcgggatcttcatcacggataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaagacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgcagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagccttgggcatgatggtcctcaaaatagtgagaaatatggagaagtaccaattggcagtgactatcatggctatctcgtgtgtcccaaatgcagtgatattgcaaaacgcatggaaggtgagttgcacaatattggcagcggtgtccgtttctccactgctcttgacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcagggagcagcccaatcctgtcaataacaatatcagaggatggcagcatgtcgataaaaaatgaagaggaagaacaaacactgactatactcatcagaacgggattgttggtgatctcaggagtctttccagtatcgataccaatcacggcagcagcatggtacttgtgggaagtgaagaaacaacgggctggagtattgtgggacgtcccttcacccccaccagtgggaaaggccgaactggaagatggagcctatagaatcaagcaaagagggattcttggatactctcagattggagccggagtttacaaagaaggaacattccatacaatgtggcatgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttagaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacattcactatgaggctgctatcaccagtcagagtgccaaattacaacctgatcatcatggacgaagcccacttcacagacccagcaagtatagcggctagaggatacatttcaactcgagtagagatgggtgaagcagctgggattttcatgacagccactcctccgggaagtagagacccatttcctcagagcaatgcaccaatcatggatgaggaaagagaaatccccgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggactttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctggataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaaggaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagatctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacggctattgctaaccaagccacagtgctaatgggtcttgggaaaggatggccattgtcaaagatggacatcggagttcccctccttgccattggatgctactcacaagtcaaccctataactctcacagcagcccttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatctcaaggatgttgattaacagattcacaatgaaacacaagaaagccacctacgagccagatgttgacttaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 7124 - RNA, 9876 nt, synthetic construct
  misc_feature 1..9876: note = derived and/or modified CDS sequence (wt) from DENV-2__GQ398267__SS-prME
  source 1..9876: mol_type = other RNA
actgcaggtataattattatgatgatcccaacagtgatggcgttccatttaaccacacgcaacggagaaccacacatgatcgttagtagacaagagaaggggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatcccgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagcttaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacagcccagtcaacatagaagcagaacctccatttggagacagctacatcattataggagtagaaccaggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagctatctatggggccgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaagcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggccatcttgtgcgtcccaaatgcagtgatattgcaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcattagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagctacccctcctggaagcagagacccatttccccagagcaatgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatattaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcattgcagcccttctcttattggtagcccattatgctatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacataggagagacgcttggagagaaatggaaaaaccggttgaatgcattagggaagagtgaattccagatctacaagaaaagtggaatccaggaagtggatagaaccttagcaaaagaaggcatcaaaagaggagagacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccaccagaaaagtgtgacacactgctgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcactacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactacgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagttaaagaagaaattgcagtgaaaaactggttaataagagtggggcgtgagaggttatcaagaatggccatcagtggagatgattgtgttgtgaaacccttagatgacaggtttgcaagtgctctaatagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattgggttccaacaagtcgaacaacctggtccatacacgccacacacgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7125 - RNA, 9876 nt, synthetic construct
  misc_feature 1..9876: note = derived and/or modified CDS sequence (wt) from DENV-2__GQ398266__SS-prME
  source 1..9876: mol_type = other RNA
actgcaggtataattattatgatgatcccaacagtgatggcgttccatttaaccacacgcaacggagaaccacacatgatcgttagtagacaagagaaggggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatcccgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacagcccagtcaacatagaagcagaacctccatttggagacagctacatcattataggagtagaaccaggacaactgaagctcagctggtttaagaaaggaagttctattggccaaatgtttgagacaacaatgagaggagcgaagagaatggccattttaggtgacacagcctgggattttggatctctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtactagtgggggtcgtgacattgtatttgggagttatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaagcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactaacaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcattagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagctacccctcctggaagcagagacccatttccccagagcaatgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcattgcagcccttctcttattggtagcccattatgctatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcactacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagttaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7126 - RNA, 9876 nt, synthetic construct
  misc_feature 1..9876: note = derived and/or modified CDS sequence (wt) from DENV-2__GQ398265__SS-prME
  source 1..9876: mol_type = other RNA
actgcaggtataattattatgatgatcccaacagtgatggcgttccatttaaccacacgcaacggagaaccacacatgatcgttagtagacaagagaaggggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatcccgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacagcccagtcaacatagaagcagaacctccatttggagacagctacatcattataggagtagaaccaggacaactgaagctcagctggtttaagaaaggaagttctattggccaaatgtttgagacaacaatgagaggagcgaagagaatggccattttaggtgacacagcctgggattttggatctctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtactagtgggggtcgtgacattgtatttgggagttatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaagcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactaacaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcattagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagctacccctcctggaagcagagacccatttccccagagcaatgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgctatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcactacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagttaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7127 - RNA, 9876 nt, synthetic construct
  misc_feature 1..9876: note = derived and/or modified CDS sequence (wt) from DENV-2__KX702403__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttgatcttactgacagctgttgctccttcaatgacaatgcgctgcataggaatatcaaatagagacttcgtagaaggggtttcaggaggaagctgggttgatatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgtaaaaagaacatggaaggaaaaatcgtacagccagaaaatttggaatacaccatcgtgataacacctcactcaggagaagagcacgctgtaggcaatgacacaggaaagcatggaaaggaaatcaaaataacaccacagagttccaccacagaagcagaactgacaggctatggcactgtcacgatggagtgctccccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgcaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagttgccactggccaaagtcacacaccctatggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtgaaaaaagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgacgcgttagccttgggtatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagatcggagccggagtttacaaagaaggaacattccatacaatgtggcacgtcacacgtggtgctgttctgatgcatagagggaagaggattgaaccatcatgggcagacgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagacagaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacactaatcctggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgagaatgaccagtacatatacatgggggaacctctcgaaaatgatgaagactgtgcacactggaaagaagctaaaatgctcctagataacatcaacacacccgaaggaattattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcacgctctcagtgaattgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctattcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccccatgatccaaaatttgaaaagcagttaggacaagtaatgctcctaatcctctgcgtgactcaagtattaatgatgaggactacatgggctttgtgtgaggctctaaccctggcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaatgtgggagagacgcttggagaaaaatggaaaagccgattaaatgcactgggaaaaagtgaatttcagatctacaagaaaagtggaatccaggaagtggatagaactctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgtaacattggaattgaaagtgagacaccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttccaatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgatagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaacactttcaccaatatggaagcccaattaattagacagatggaaggagaaggaatcttcaaaagcattcagcacctgaccgccacagaagaaaccgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaatcaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggattcaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatcaatgaagagattcagaagggaagaggaagaggcaggtgtcctgtggtag

SEQ ID NO: 7128 - RNA, 9876 nt, synthetic construct
  misc_feature 1..9876: note = derived and/or modified CDS sequence (wt) from DENV-2__KX702404__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtaggtatgggactggagacacgaactgaaacatggatgtcatcagaaggggcctggaagcacgttcagagaattgaaacctggatcttgagacatccaggttttaccataatggcagcgatcctggcatacaccataggaacgacacacttccaaagggccttgattttcattttactgacagctgttgctccttcaatgacaatgcgctgcataggaatatcaaatagagacttcgtagaaggggtttcaggaggaagctgggttgatatcgttttagaacatggaagttgtgtgacgacgatggcaaaaaacaaaccaacactggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattagtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaagtcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctaggaggagtgtttacatctataggaaaggctcttcatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgagataaagttgaccattatgacaggagatattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctctttcattgaagttaaaagctgccactggccaaagtcacacaccctatggagcaatggagtattagaaagtgagatgataattccaaaaaactttgccgggccagtgtcacaacacaactacagaccaggctaccatacacaaacagcaggaccttggcatctaggtaagcttgagatggactttgatttctgcgaaggaactacagtggtggtgaccgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcattaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcattgacgataaaaggtctcaacccaacagccatttttctaacaactctttcgagaaccagcaagaaaaggagctggccgctaaatgaagccatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacagacactgaccatactcattagaacgggattgttggtgatctcaggagtctttccagtatcgataccaattacggcagcagcatggtacctgtgggaagtgaagaaacaacgggctggagtattgtgggacgttccttcacccccaccagtggaaaaagccgaactggaagatggagcctatagaatcaagcaaagagggattcttggatattctcagattggagccggagtttacaaagaaggaacattccatacaatgtggcacgtcacacgtggtgctgttctgatgcacagagggaagagaattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacactaatcctggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacccatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcattaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgatccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcacgctctcagtgaattgccggagactctggagacactgcttctactgacactcctggcagcagttacaggaggaatcttcttattcttaatgagcggaaaaggtatagggaagatgactctgggaatgtgttgcataatcacagctagcattctcctatggtacgcacagatacaaccacactggatagcagcttcaataatactggagttttttctcatagttttgctcattccagaaccagaaaaacagagaacaccccaagacaaccaattgacctacgttgtcatagccatcctcacagtggtggctgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtgggagagacgcttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggagagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacatagtgggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaatcacggcagagtggctttggaaagaactaggaaaggaaaagacacctagaatgtgtaccagagaagaattcacaagaaaagtgagaagcaatgcagccttgggggccgtattcaccaatgaaaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggctaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagttggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcagcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagagaagaggaagaggcaggtgtcctgtggtag

SEQ ID NO: 7129 - RNA, 9873 nt, synthetic construct
  misc_feature 1..9873: note = derived and/or modified CDS sequence (wt) from DENV-2__JQ686088__SS-prME
  source 1..9873: mol_type = other RNA
accacaggcatgatcatcatgctgattccaacagtgatggcgttccatttaaccacacgcaacggagaaccacacatgattgtcagcagacaggataaagggaaaagccttctgtttaagacaaaggatggcacgaacatgtgtaccctcatggccatggaccttggtgaattgtgtgaagacacaatcacgtataaatgtccctttctcaagcagaacgaaccagaagacatagattgttggtgcaactccacgtccacatgggtaacttatgggacgtgcaccaccacaggagagcacagaagagaaaaaagatcagtagcgctcgttccacatgtgggaatgggattggagacacgaactgaaacatggatgtcatcagaaggagcctggaaacatgcccagagaattgaaacttggatcctgagacatccaggctttaccataatggcagcaatcctggcatacaccataggaacgacacatttccaaagagtcctgattttcatcctactgacagctgtcgctccttcaatgacaatgcgctgtataggaatagcaaatagggacttcgtggaaggggtttcaggaggaagctgggttgacatagtcttagaacacggaagctgtgtgacgacgatggcaaaaaacaaaccaacactggactttgaactgataaaaacagaagccaaacaacccgccactctaaggaagtactgcatagaggctaagctgaccaacacgacaacagattcgcgctgcccaacacaaggggaacctagcctgaatgaagagcaggacaaaaggtttgtctgcaaacattctatggtagacagaggatggggaaatggatgcggattgtttggaaaaggaggcatcgtgacctgtgctatgttcacatgcaaaaagaatatgaaaggaaaaattgtgcagccagaaaacttggaatacaccatcgtgataacacctcactcaggggaagaacatgcagtcggaaatgacacaggaaaacatggcaaggaagtcaaaataacaccacagagctccatcacagaagcggaactgacaggctatggcactgttacgatggagtgctctccgagaacgggcctcgacttcaatgagatggtgttgctgcaaatggaagataaagcttggctggtgcacagacaatggttcctagacctgccgttaccatggctgcccggagcagatacacaaggatcaaattggatacagaaagagacattggtcactttcaaaaatccccatgcaaaaaaacaggatgttgttgtcttaggatcccaagagggggccatgcacacagcactcacaggggctacggaaatccagatgtcatcaggaaacctactgttcacaggtcatcttaagtgcaggctgagaatggacaaactacagcttaaagggatgtcatactctatgtgtacagggaagtttaaagtcgtgaaggaaatagcagaaacacaacatggaacaatagtcattagagtacaatatgaaggagacggctccccatgcaagatcccttttgagataatggatctggaaaaaagacatgtcttaggtcgtctgattacagtcaacccaattgtaacagaaaaggacaggccagtcaacatagaagcagaacctccattcggagacagctacattatcataggagtggagccgggacaactgaagcttaactggttcaagaaaggaagttctatcggtcaaatgtttgagacaacaatgagaggagcgaaaagaatggccattttaggtgacacagcctgggattttggatctctgggaggggtgtttacatcaataggaaaggctctccaccaggtctttggagcgatctatggggctgccttcagtggggtctcatggactatgaagatcctcataggagttatcatcacatggataggaatgaactcacgtagcacttcactgtccgtgtcactagtattagtgggaatcgtgacactatacttgggagtcatggtgcaggccgacagtggttgcgttgtgagctggaagaacaaagaactgaaatgcggcaatgggatatttgtcacagataacgtgcatacatggacagaacaatacaagttccaaccagaatccccttcaaaactggcttcagctattcagaaagctcatgaagagggcatttgtggaatccgctcagtaacaagactggaaaatcttatgtggaaacagataacaccggaattgaaccacatcctatcagaaaatgaagtgaagctgactatcatgacaggagacattaaaggaatcatgcaggtaggaaaacgatctctgcagccccaacccactgagctgaggtattcatggaaaacatggggtaaagcaaaaatgctctccacagaactccacaaccagaccttccttattgatggtcccgaaacagcagaatgccccaacacaaacagagcttggaattcactggaagttgaggactatggctttggagtattcaccaccaatatatggctaaaattgagagagaagcaggatgtattttgtgactcaaaacttatgtcagcggccataaaggacaacagagccgtccatgctgatatgggttattggatagaaagtgcactcaatgacacatggaagatagaaaaagcctctttcattgaagttaaaagttgccactggccaaagtcacacactctttggagcaatggagtgctagaaagtgagatgataattccaaagaatctcgctggaccagtgtcacaacacaataacagaccaggctattacacacaaacagcaggaccttggcatctaggcaaacttgagatggactttgatttctgcaaaggaactacagtggtggtgaccgaggactgtggaaacagaggaccctctttaagaacaaccactgcctctggaaaacttataacggaatggtgctgtcgatcttgcacattgccaccgttaagatacagaggtgaggatggatgctggtatgggatggaaattagaccattgaaagagaaagaagaaaatctggtcaattccttggtcacagccggacatgggcagattgataatttttcactaggaatcttgggaatggcattgttccttgaagaaatgctcaggacccgagtgggaacgaaacatgcaatattactagtcgcagtttctttcgtgacattaatcacagggaacatgtcttttagagatctgggaagagtgatagttatggtaggtgccactatgacagatgacataggcatgggcgtgacttatctcgctctactagcagctttcaaagtcagaccaacctttgcagctggactgctcttgagaaaactgacctccaaggaattaatgatgactaccataggaatcgttcttctctcccagagtagcataccagagaccattctcgaactgactgacgcgttagccctgggcatgatgatcctcaagatggtgagaaatatggaaaaataccagttggcagtgactatcatggccatcttgtgcgtcccaaatgctgtgatattacaaaacgcatggaaagtgagttgcacaatattggcagtggtgtctgtttccccactgctcttaacatcctcacaacagaaagcggattggataccaatagcgttgacgatcaaaggtctcaatccgacagctatttttctaacaaccctttcaagaaccagtaagaaaaggagctggccattgaatgaggccattatggcagtcgggatggtgagcatattggccagttctctcttaaagaatgacatccccatgacaggaccactggtggctggagggctccttactgtgtgctacgtgctgactggacgatcggctgatttggaattggagagagctgccgacgtcaaatgggaagaccaggcagagatatcagggagtagtccaatcctgtcaataacaatatcagaagatggcagcatgtcaataaagaatgaagaggaagaacaaacactgaccatactcatcagaacaggactgctggtggtttcagggctttttcccgtgtcagtaccaattacagcagcagcatggtatctgtgggaagtgaagaaacaacgggctggagtattgtgggacgtcccctcacccccgccagcgggaaaagctgaattggaggatggagcctataggattaagcaaaaaggaattcttggatattctcagatcggagccggagtttacaaagaaggaacattccacacaatgtggcatgtcacacgtggggccgtcctaatgcacaaagggaagaggattgaaccatcatgggcggacgtcaagaaagacttaatatcatatggaggaggttggaagctagaaggagaatggaaagaaggagaagaagtccaggtcttggcattggagcctgggaaaaatccaagagccgtccaaacaaaacctggccttttcaaaaccaacaccggaaccataggtgctgtatctctggacttttctcctgggacatcaggatctccaattgtcgacaaaaaaggaaaagttgtgggtctctatggcaatggtgtcgttacaaggagtggagcatatgtgagtgccatagctcaaaccgaaaaaagcattgaagacaatccagagattgaagatgacatcttcagaaagagaagactgaccatcatggacctccacccaggagcaggaaagacgaagagatacctcccggccatagtcagagaggccataaaaagaggcttgagaacactaatcctagcccccaccagagttgtggcagctgaaatggaggaagcccttaggggacttccagtaagataccaaaccccagctatcagggctgagcacaccgggcgggagattgtggacttaatgtgtcacgccacatttaccatgaggctgctatcaccaatcagagtgccaaactacaacttgatcatcatggacgaagcccactttacagatccagcaagtatagcagctaggggatacatctcaactcgagtggagatgggcgaggcagctggaatttttatgacagccactcctccgggcagcagagatccattccctcagagcaacgcaccaatcatggacgaagaaagagaaattcctgaacgttcatggaattctggacatgagtgggtcacggatttcaaaggaaagactgtctggtttgttccaagcataaaaaccggaaatgacatagcagcttgcctgagaaagaatggaaagagggtgatacaactcagtaggaagacctttgattctgaatacatcaagactagaaccaacgattgggatttcgtggtcacaactgacatctcggaaatgggcgctaacttcaaggctcagagggttatagaccccagacgttgcatgaaaccggttatactgacagacggtgaagagcgggtgattctagcaggacccatgccagtgacccactctagtgcagcacaaagagggagagtaggaaggaatccaaaaaatgaaaatgaccagtatatatacatgggggaacctttggaaaatgatgaagactgtgcgcactggaaggaagccaagatgctcctagacaacatcaacacacctgaaggaatcattcctagcatgttcgagccagagcgtgagaaggtagatgctattgatggtgagtaccgcttgagaggagaagcaaggaaaacttttgtggacctgatgagaagaggagacctaccagtttggttggcttataaagtggcggctgaaggcatcaattacgcagacagaagatggtgttttgacggaaccagaaacaatcaaatcttggaagagaatgtggaagtagagatctggacaaaagagggggaaaggaagaaattgaaacctagatggttggatgctaggatctatgctgacccactggcgctaaaagaattcaaggaattcgcagccggaagaaagtccctgaccttgaacctaatcacagaaatgggtaggctcccaactttcatgactcagaaggtcagagatgcactggacaacttagcggtgttgcacacggctgaagcaggtggaaaggcatacaatcatgctctcaatgaactaccggagaccctggagacattgcttttgctgacacttttggctacagtcacggggggaatttttctattcttgatgagcggaaggggtatagggaagatgaccctgggaatgtgctgcataatcacggctagtatcctcttatggtatgcacaaatacaaccacactggatagcagcttcaataatattggagttctttctcatagtcttgctcattccagaaccagaaaagcagaggacaccccaggacaaccaattgacttatgtcgtcatagccatcctcacagtggtggccgcaaccatggcaaacgaaatgggtttcctggaaaaaacaaagaaagatcttggattgggaagcattgtaactcagcaacccgagagcaacattctggacatagatctacgccctgcatcagcatggacgctgtatgccgtggccacaacatttatcacaccaatgttaagacacagcattgaaaactcctcagtaaatgtgtccctaacagccatcgctaaccaagctacagtgttaatgggtcttgggaaaggatggccattgtcaaagatggacattggagttccccttctcgctattgggtgttattcacaagtcaaccccataaccctcacagcggctctttttttattggtagcacactatgccatcataggcccaggactccaagctaaagcaactagagaagctcagaaaagagcagcagcgggcatcatgaaaaacccgactgtggatggaataacagtgatagacctagatccaataccctatgatccaaagtttgaaaagcagttgggacaagtaatgctcctagtcctctgtgtgactcaagtgttgatgatgaggactacgtgggctttgtgcgaggccttaactctagcaaccgggcccgtatccacattgtgggaaggaaatccaggaaggttctggaacacaaccatcgcagtatcaatggcaaacatttttagagggagttacctagctggagctggacttctcttttcaatcatgaagaacacaaccagtgcgaggagaggaactggcaacataggagaaactctaggagagaaatggaaaagccggctgaacgctttggggaaaagtgaattccagatctacaagaaaagtggaattcaagaagtggacagaaccttagcaaaagaaggcattaaaagaggagaaacggatcatcacgctgtgtcgcgaggttcagcaaaattgagatggttcgttgaaagaaatctggtgacaccagaagggaaagtagtggaccttggttgcggcagagggggctggtcatactattgtgggggactgaagaatgtaagagaagttaaaggcctgacaaaaggaggaccaggacacgaagaacccatccccatgtcaacatatgggtggaatctagtacgtttacagagtggagttgacgttttcttcattccgccagagaggtgtgacacattgttgtgtgacataggagaatcgtcaccaagtcccacggtagaagcaggacgaacacttagagtccttaatctggtagaaaattggctgagcaacaacactcaattttgtgtaaaagttcttaacccgtatatgccctcagtcattgaaaaaatggaagccctgcaacggaaacacggaggagccttggtgagaaacccactctcacgaaactccacacatgagatgtactgggtgtccaatgcttccgggaacatagtgtcatcagtgaacatgatttcaagaatgttgattaacagatttactatgagacacaagaaggccacttatgagccagatgttgaccttggaagcggaacccgcaatattggaattgagagtgagacaccaaacctagacataattgggaaaagaatagaaaaaataaaacaagagcatgaaacatcatggcactatgaccaagaccacccatacaaaacatgggcttaccatggcagttatgaaacaaaacagactggatcagcatcatccatggtgaacggagtagtcagactgctaacaaaaccctgggacgttgttcccatggtgacacagatggcaatgacagacacaactccttttggacaacagcgtgtctttaaggagaaggtggatacgagaacccaagaaccgaaagaaggcacaaaaaaattaatgagaatcacggcagagtggctttggaaagaactaggaaagaaaaagacacctagaatgtgcaccagagaagaattcacaaaaaaggtgagaagcaatgcagccctgggggccatattcactgatgagaacaagtggaaatcggcgcgtgaggctgttggagatggtaggttttgggagctggttgacaaggaaaggaatctccatcttgaaggaaagtgtgaaacatgtgtgtacaacatgatgggaaaaagagaaaagaaactaggggagtttggcaaagcaaaaggcagcagagccatatggtacatgtggcttggagcacgcttcttagagtttgaagccctgggattcttgaatgaagaccattggttctccagagagaactccctgagtggagtggaaggagaagggctgcacaagctaggatacatcttaagagaagtgagcaagaaagagggaggagcaatgtatgccgatgacaccgcaggctgggacacaagaatcacaatagaagacctgaaaaatgaagaaatgataacgaaccacatggaaggagaacacaagaaactcgctgaggccattttcagattgacgtatcaaaacaaggtggtgcgtgtgcaaagaccaacacctagaggtacagtaatggatatcatatcaagaagagaccaaaggggtagtggacaagttggtacctatggcctcaacactttcaccaacatggaagcacaactaatcagacagatggagggggaaggagttttcaaaagcatccagcacttgacagccgcagaagaaattgctgtgcaaaattggttggtgagagtagggcgtgaaaggttatcaagaatggccatcagtggagatgattgcgttgtgaaacctctagatgatagatttgcaagagctctaacagctctaaatgacatgggaaaggttaggaaggatatacaacagtgggaaccttcaagaggatggaacgactggacacaagtgcccttctgttcacaccattttcatgagctaatcatgaaagacggccgcatactcgtagttccatgtagaaaccaagatgaattgattggcagagcccgaatatcccagggagccgggtggtccttacgggaaacggcctgtttgggaaagtcttatgcccaaatgtggagcttgatgtatttccacagacgtgatctcaggctagcggcaaatgctatttgctcggcagtcccatcacactgggtcccaacaagtcgaacaacctggtccatacacgccagccatgaatggatgacgacggaagacatgttgacagtctggaacagggtgtggattcaagaaaatccatggatggaagacaaaactccagtggaatcatgggaggaaatcccatacttgggaaaaagagaagaccaatggtgcggctcactgatcgggctgacaagcagggctacctgggcgaagaacatccagacagcaataaatcaagtcagatccctcattggcaatgaagaatatacagattacatgccatccatgaaaagattcagaagagaagaggaagaggcaggagttttgtggtag

SEQ ID NO: 7130 - RNA, 9876 nt, synthetic construct
  misc_feature 1..9876: note = derived and/or modified CDS sequence (wt) from DENV-2__KF479233__SS-prME
  source 1..9876: mol_type = other RNA
actgcgggcgtgatcatcatgctaattccaacagcgatggcgtttcatttaaccacacgcaacggagaaccacacatgatcgtcagcagacaagagaaagggaaaagtctcttgttcaaaacagaggatggtgtgaacatgtgtaccctcatggccatggaccttggtgaactgtgtgaagacacaatcacttataactgtcctcttctcaggcagaatgaaccagaagatatagattgttggtgtaactccacgtccacatgggtaacttatgggacatgcactgccacaggagaacacagaagggaaaaaagatcagtggcactcgtcccacatgtgggaatgggattggagacacgaactgaaacatggatgtcatcagaaggggcctggaaacatgcccagagaattgaaacctggatcttgagacatccaggttttaccataatggcagcaatcttggcatacaccataggaacgacatacttccaaagagtcctgatcttcatcttactgacagctgtcgccccttcaatgacaatgcgttgtattggaatatcaaatagagactttgtggaaggggtttcaggaggaagctgggttgacatagtcttagaacatggaagctgcgtgacaacgatggcaaaaaacaaaccaacattggactttgaactgataaaaacagaagccaagcaacctgccactctaaggaagtactgtatagaagcaaagctgaccaacacaacaacagcatctcgatgcccaacacaaggagaacccagcctaaatgaagaacaggacaaaaggtttgtctgcaaacattccatggtagacagaggatggggaaatggatgtggattatttggaaagggaggcatcgtgacctgtgctatgttcacatgcaaaaaaaacatggaaggaaaaattgtgcaaccagaaaacctggaatacaccattgtggtaacacctcattcaggggaagagaatgcagttggaaatgacacaggaaaacatggcaaggaaatcaaagtaacaccacagagttccattacagaagcagaactgacaggctacggcactgtcacgatggagtgctctccaagaacgggcctcgacttcaatgaaatggtgttgctgcaaatggaaaataaggcttggctggtgcataggcaatggttcttagacctgccgttaccatggttgcccggagcggacacacaaggatcaaattggatacagaaggagacgttggtcaccttcaaaaatccccatgcgaagaaacaggatgttgttgttttaggatcccaagaaggggctatgcatacagcacttacaggggccacggaaatccagatgtcatcaggaaacctactgttcacaggacatctcaagtgcaggctgagaatggataaattacagctcaaaggaatgtcatactctatgtgcacaggaaagtttaaagttgtaaaggaaatagcagagacacaacatggaacaatagttgtcagagtacaatatgaaggggatggctctccatgtaaaatcccttttgagataatggatttggaaaaaagacatgtcttaggtcgcctgattacagtcaacccaatcgtaacagaaaaagacagtccagtcaacatagaagcagaacctccatttggagacagctacatcattataggagtagaaccgggacaactgaagctcagctggtttaaaaaaggaagctcaatcggccaaatgttcgagacaacaatgagaggagcgaagagaatggccattttaggtgacacagcctgggattttggatccctgggaggagtgttcacatctataggaaaggccctccaccaagtctttggagcaatctatggggctgccttcagtggggtctcatggactatgaaaattctcataggagttgtcatcacatggataggaatgaattcacgtagcacctcactgtctgtgtcactagtattagtgggagtcgtgacattgtatttgggagttatggtgcaggctgatagtggttgtgttgtgagttggaaaaacaaagaattgaaatgtggcagtgggatttttatcacagacaatgtacacacatggacagaacaatacaaattccaaccagaatccccctcaaagctggcttcagctatccagaaagctcatgaagagggcatttgtggaatccgctcagtgacaagactagagaatctaatgtggaaacaaataacacccgaactgaatcacatcctatcagaaaatgaggtaaagctgaccatcatgacaggagacatcaaaggtatcatgcaggcaggaaaacgatccctgcggcctcagcccactgagctgaagtattcatggaaaacgtggggcaaagcgaaaatgctctccacagagcctcaaaaccagacctttctcattgatggccccgaaacagcagaatgtcccaacacaaacagagcttggaactcactagaagttgaagactatggctttggggtattcaccaccaacatatggctgaagttgaaagagaggcaggatgtgttttgtgactcaaaactcatgtcagcggccataaaagacaacagagccgtccatgccgatatgggttattggatagaaagcgcacttaatgacacatggaagatagaaaaagcttcttttattgaagtcaaaagttgccactggccaaaatcacacactctctggagcaatggagtgctagaaagtgagatgataattccaaagaattttgctggaccagtatcacaacacaattacagaccaggctatcacacacaaacggcaggaccctggcatctaggcaagcttgagatggactttgatttttgcgaaggaaccacagtggtggtgactgaagactgtggaaatagaggaccctctctaagaacaactaccgcctctggaaaactcataacagaatggtgctgccgatcctgcacattaccaccactaagatacaaaggtgaggatggatgctggtacggaatggaaatcagaccattgaaggagaaagaagagaacttggtcaactccttggtcacagccggacatggacagattgacaacttctcactaggggtcttgggaatggcactgttcctggaagaaatgctcaggacccgcgtaggaacaaagcatgcagtattactagttgcagtttctttcatgacattgatcacagggaacatgtctttccgagacctggggagagtgatggtcatggtgggggctgctatgacggatgacataggtatgggcgtgacttatcttgccttactagcagccttcaaagttagaccaacttttgcagctggactgcttttgagaaagctgacctccaaggaattgatgatgaccaccataggaattgtactcctctcccagagcaccataccagagaccatactagaactgactgacgcgttggccttgggcatgatgattctcaagatagtgaggaatatggaaaagtatcaattagcagtgactatcatggctatcttatgtgttccaaatgcagtgatattacaaaatgcatggaaagtgagctgcacaatactggcagtggtgtccgtatccccactgctcttaacatcttcacagcagaaagcggattggataccattggcattgacgatcaaaggtctcaatccaacagccattttcctaacaaccctttcaagaactaacaagaaaaggagttggccactaaatgaggctatcatggcagtagggatggtgagcattttagccagttctctcttgaagaatgatattcccatgacaggaccactggtggctggagggcttctcactgtgtgttacgtgctcactggaagatcggccgacttggaactggagagagccgccgacgtaagatgggaagatcaggcagagatatcaggaagcagtccaattctgtcaataacaatatcggaagatggcagcatgtcgataaaaaatgaagaggaagaacaaacactgaccatactcattagaacaggattgctggtgatatcaggactttttcccgtatcaataccaattacggcagcagcatggtacctgtgggaagtgaagaaacaacgggctggagtattgtgggatgttccttcacccccacctgtgggaaaggccgaactggaagatggagcttatagaatcaagcagaaagggattcttggatactcccagatcggagctggagtttacaaagaaggaacattccacacaatgtggcacgtcacacgtggtgctgttctaatgcacaaagggaagaggattgaaccatcatgggcggatgtcaggaaagacctaatatcgtatggaggaggctggaagctagaaggagaatggaaggaaggagaagaagtccaggtcttggcattagagcctggaaagaatccaagagccgtccaaacaaaacccggtctttttaaaactaacaccggaaccataggtgctgtgtctctagacttttctcctggaacgtcaggatccccaattgtcgacaaaaaaggaaaggtcgtgggtctctatggcaatggtgtcgtcacaaggagtggaacatatgtgagtgccatagcccagactgaaaaaagcattgaagacaatccagagattgaagatgatatctttcggaaaaaaagattaaccatcatggacctccacccaggagcgggaaagacgaaaagataccttccagcaatagtcagagaggccataaaacgaggcttaagaacattaatcctggcccccaccagagtcgtggcagccgaaatggaagaagctcttagaggacttccaataagataccaaaccccagccattagagctgagcacactgggcgagaaatcgtggatttaatgtgtcatgccacatttaccatgaggctgttatcaccagttagagtgccaaattacaacttgattattatggatgaagcccatttcacagacccagcaagcatagcagccagaggatacatttcaactcgagtggagatgggtgaagcagctgggattttcatgacggccactcctccgggaagcagagacccatttcctcaaagcaatgcaccaatcatggatgaagaaagggaaatccctgaacgttcgtggaactctggacatgagtgggttacagattttaaagggaagactgtttggtttgttccgagtataaaagcaggaaatgatatagcagcttgcctgagaaaaaatggaaagaaagtgatacagcttagtaggaagacctttgattctgaatacatcaagaccaggaccaatgattgggattttgtggtcacgactgacatttcagaaatgggtgctaacttcaaggctgaaagggttatagaccccaggcgctgcatgaagccagtcatattgacagacggtgaagagcgggtgatcctggcaggacccatgccagtgactcactctagtgcagcacaaagaagagggagaataggaagaaatccaaaaaatgaaaatgaccagtacatatacatgggggaacctctggaaaatgatgaagactgcgcacactggaaagaagccaagatgcttttagacaacatcaacacgcctgaaggaatcattcccagcatgttcgaaccagagcgtgaaaaagtggatgccattgatggtgaataccgcttaagaggagaagcgaggaaaacctttgtggagctaatgagaagaggagacctaccagtctggctggcctacagagtggcagccgaaggcatcaactatgcagatagaaggtggtgttttgatggaatcaagaacaaccaaatcttggaagaaaatgtggaagtggaaatctggacaaaagaaggagaaaagaagaaactgaaacccagatggttggatgctaggatctactctgacccactggcgctcaaagaattcaaagagtttgcagctggaagaaaatccctgaccatgaatttaatcacagaaatgggtaggctcccaacttttatgactcagaaagcaaggaacgcactggacaacttagcagtcctgcatacagctgaagcaggcggaagggcgtacaatcatgctctcagtgaactgccagagaccctggagacattgcttttgctcacgctcttggccacagtcacgggcggaatctttttattcttgatgagtggaaaaggcatagggaaaatgaccctgggaatgtgttgcataattacggccagcattctcctatggtacgcacaaatacagccacactggatagcagcttcaataatactggagttttttctcatagtcttgctcattccagagccagaaaaacaaagaacaccccaagacaaccaattgacttatgttgtcatagccatcctcacagtggtggccgcaaccatggcaaacgagatggggttcctggaaaaaacgaaaaaagatttcggattggggagcattgtaacccagcaacccgagagcaacattctggacatagatctacgtcctgcatcagcatggaccctgtatgcagtggccacaacatttatcacaccaatgttgagacatagcattgaaaattcctcagtgaatgtgtctctaacagccattgccaatcaagccacagtgctaatgggtcttgggaagggatggccattgtcaaaaatggacattggagttccccttctcgccatcgggtgctattcacaagtcaaccccataacccttacagcagcccttcttttattggtagcacactatgctatcatagggccaggactccaagcaaaagcaaccagagaagcgcagaaaagagcagcagcaggcatcatgaaaaacccaactgtggatggaataacagtgattgacctagatccaataccctatgatccaaaatttgagaagcagctgggacaagtaatgctcctagtcctctgcgtgactcaagtactgatgatgaggactacatgggctttgtgtgaggctctaaccttagcgaccgggcccatctccacattgtgggaaggaaatccagggagattttggaacacaaccattgcagtgtcaatggctaacatttttagaggaagttacctagctggagccggacttctcttttccatcatgaagaacacagccaacacaagaaggggaactggtaacacaggagagacgcttggggaaaaatggaaaaaccgattgaattcattggggaagagtgaattccagatttacaagagaagcggaatccaggaagtggatagaaccttggcaaaagaaggcattaaaagaggagaaacggaccatcacgctgtgtcgcgaggctcagcaaagctgagatggttcgtcgagagaaacctggttacaccagaggggaaagtgatggacctcggttgcggtagagggggctggtcatactattgtgggggtctaaagaatgtaagagaagtcaaaggcctaacaaaaggaggaccaggacacgaagaacccattcccatgtcaacatatgggtggaatcttgtgcgtctccaaagtggagttgatgttttctttactccgccagaaaagtgtgacacattgttgtgtgatataggggagtcgtcaccaaatcccacggttgaagcaggacgaacacttagagtcctaaacttggtagagaattggctgaacaacaacacccaattttgcataaaggttctaaacccatacatgccctcagtcatcgaaaaaatggaaacgctgcaaaggaaatacggaggagctttggtgaggaatccactctcaagaaattccacacatgagatgtattgggtatccaatgcttccgggaacatagtgtcatcagtgaacatgatttcaaggatgttgatcaatagattcacaatgagacataagaaggccacatacgagccagatgttgacctcggaagcggaacccgcaacatcggaattgaaagtgagataccaaacctagacataattgggaaaagaatagaaaaaataaaacaagagcatgagacatcatggcactatgaccaagaccacccatataaaacgtgggcctaccatggcagctacgaaacaaaacagactggatcagcatcatccatggtgaatggagtagttagactgctgacaaaaccttgggacgtcatccctatggtgacacagatggcaatgacagacacgaccccatttggacaacagcgtgttttcaaagagaaagtggacacgagaacccaagaaccgaaagaaggcacgaagaaactaatgaaaatcacggccgaatggctctggaaagaactaggaaagaaaaagacacctagaatgtgcaccagagaagaattcacaagaaaggtgagaagcaatgcagccctaggtgccatattcactgatgagaataagtggaagtcggcacgtgaggctgttgaagacagtagattttgggaactggttgacaaggaaaggaatctccatcttgaaggaaagtgtgagacatgtgtgtacaacatgatgggaaagagagagaagaagataggagaattcggcaaagcaaaaggcagcagagccatatggtacatgtggcttggagcacgcttcttagagtttgaagccctgggattcctgaatgaagatcactggttttccagagagaactctctgagcggagtggaaggagaagggctgcacaagctgggttacattctaagagaagtgagcaaaaaagaaggaggagcaatgtacgccgacgacacagcaggatgggacacaagaatcacactagaggacttaaaaaatgaagaaatggtgacaaaccatatggaaggagaacacaagaaacttgctgaggccattttcaagttaacgtaccaaaacaaggtggtgcgtgtgcaaagacccacaccaagaggcacagtaatggatattatatcgagaagagaccaaagaggtagtggacaagttggcacctatggcctcaacacctttaccaatatgggagcccaactaatcagacagatggagggagaaggagtctttaaaagcatccagcatctgacaaccacagaagaagtagcagtgcaagactggttagcaagagtggggcgtgagaggttatcgagaatggccatcagtggagatgattgtgttgtgaaacccttagatgacaggtttgcaagcgctttaacagctctaaatgacatgggaaaggttaggaaagacatacaacaatgggaaccttcaagaggatggaacgactggacacaagtgcctttctgttcacaccatttccatgagttaatcatgaaagacggtcgtgtgctcgtagttccatgtagaaaccaagatgaactgattggtagagctcgaatttcccagggagccgggtggtctttgcgggagacggcctgtctggggaagtcttacgcccaaatgtggagcctgatgtacttccacagacgtgacctcaggctggcggctaacgctatttgctcggcagtcccatcacactgggttccaacaagtcgaacaacctggtccatacacgccagacatgaatggatgacaacagaagacatgctgacagtctggaacagggtgtggattcaagaaaacccatggatggaagacaaaactccagtggaatcatgggaggaaatcccatacttggggaaaagagaagaccaatggtgcggctcattgatagggttgacaagcagagccacctgggcaaagaacatccaaacagcaataaaccaagttagatccttaataggcagtgaggaatacacagactatatgccatccatgaaaagattcagaagagaagaggaagaggcaggggtcttgtggtag

SEQ ID NO: 7131 - RNA, 9876 nt, synthetic construct
  misc_feature 1..9876: note = derived and/or modified CDS sequence (wt) from DENV-2__KX372564__SS-prME
  source 1..9876: mol_type = other RNA
actgcaggtataattattatgatgatcccaacagtgatggcgttccatttaaccacacgcaatggagaaccacacatgatcgtcagtagacaagagaaagggaaaagtcttctgtttaaaacagagaacggtgtgaacatgtgcaccctcatggccatggatcttggtgaactgtgtgaagacacaatcacttacaattgtcctcttctcaggcagaatgaaccagaagacatagactgttggtgcaactctacgtctacatgggtaacttatgggacatgcaccgctacaggagaacacagaagggaaaaaagatcagtggcactcgttccacatgtgggaatgggactggagacacgaactgaaacatggatgtcatcagaaggggcctggaaacatgcacagagaattgaaacttgggtcttgagacatccaggcttcaccataatggcagcaatcctggcatacaccataggaacgacatatttccaaagagtcctgattttcatcttactgacagctgttgctccctcaatgacaatgcgttgtataggaatatcaaatagagactttgtggaaggggtttcaggaggaagctgggttgacatagtcctggaacatggaagctgtgtgacgacgatggcaaaaaataaaccaacattggattttgaactgataaagacagaagcgaaacatcccgccactctaaggaagtattgcatagaggcaaagctgaccaacacaacaacagcatctcgctgcccaacacaaggagaacctagcctaaatgaagaacaggacaaaagatttgtctgcaaacactccatggtagatagaggatggggaaatggatgcggattatttggaaagggaggtatcgtgacctgtgcaatgttcacatgcaaaaagaacatggaagggaaaatcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggactcgacttcaatgagatggtgttgctgcaaatggaaaacaaggcttggctggtgcacaggcaatggttcttagacctgccattaccatggctgcccggagcagacacacaaggatcaaattggatacagaaggagacattggtcactttcaaaaatccccatgcaaagaaacaggatgttgttgttctaggatcccaagaaggggctatgcacacagcacttacaggggccacggaaatccagatgtcatcaggaaacttactgttcacaggacatcttaaatgtaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgtcacagaaaaagacagcccagtcaacatagaagcagaacctccattcggagacagctacatcattataggagtagaaccgggacaactgaagctcagctggtttaagaaaggaagctctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgtagcacttcactgtctgtgtcactagtattagtgggagtcgtgacattgtatttgggagttatggtgcaggccgatagtggttgcgttgtgagctggaaaaacaaagaactgaaatgtggcagtgggatttttatcacagacaacgtgcatacatggacagaacaatacaaattccaaccagaatccccttcaaagctggcttcagctatccagaaggctcatgaagaaggcatttgtggaatccgctcagtaacaagactggagaatctgatgtggaaacaaataacaccagaactgaatcacattctaacagaaaatgaggtaaagttgactatcatgacaggagacattaaaggaatcatgcaggcaggaaaacgatccctgcggcctcaacccactgagctgaagtactcttggaaagcatggggcaaagcgaaagtgctctccacagagcttcataaccacacctttctcattgatggccccgaaacagcagaatgtcccaacacaaatagagcttggaactcactagaggttgaggactatggctttggagtattcaccactaacatatggctgaaattgaaagaaaggcaggatgtatcttgtgactcaaaactcatgtcggcagccataaaagacaacagagccgtccacgccgacatgggttattggatagaaagcgcactcaatgacacatggaagattgagaaagcctcctttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaactacagtggtggtgactgaagactgtggaaatagaggaccctccttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcctgggaatggcattgttcctggaagagatgcttagaacccgagtagggacgaaacatgcaatattactagttgcagtctctttcgtgacattgatcacagggaacatgtcctttcgagatttggggagagtgatggtcatggtgggcgctactatgacggatgacataggcatgggcgtgacctatcttgccctattagcagccttcaaggtcagaccaacttttgcagctggactactcttaagaaagctgacctccaaggaattgatgatgaccaccataggaatcgtactcctctctcagagcaccataccagagaccatacttgaactgactgacgcgttggctttggggatgatggttctcaaaatagtaagaaacatggaaaagtatcaactagcagtgactatcatggctatcttgtgcgtcccaaatgcagtgatattacaaaacgcatggaaagtgagctgcacagcactggcagtggtgtccgtttccccactgcttttaacatcttcacagcagaaaacggattggataccactggcgttgacgatcaaaggccttaatccaacagccattttcttaacaaccctctcaagaactagtaagaaaaggagctggccactaaatgaggctattatggcagtcgggatggtgagcattttagccagttctttcttaaagaatgacattcccatgacaggaccactagtggctggagggcttctcactgtgtgttacgtgctcactggaagatcggctgatttggaactggagagagctgctgacataagatgggaagaacaggcagagatatcaggaagcagtccaattttgtcgataacaatatcggaagatggcagcatgtcgataaaaaatgaagaagaagaacaaacactgaccatactgattagaacaggactgctggtgatatcaggactttttcccgtgtcaataccaatcacggcagctgcatggtacctgtgggaagtgaaaaaacaacgagccggagtattgtgggatgtcccttcacctccacctgtgggaagggccgaactggaagacggagcctatagaatcaagcagaaagggattttgggatactcgcagataggagccggagtctacaaagaaggaactttccacacaatgtggcatgtcacacgtggtgctgttctaatgcataaagggaagagaattgaaccatcatgggcggacgtcaagaaggacctaatatcgtatggaggaggttggaagctagaaggagaatggaaggaaggagaagaagtccaggtcctggcattagagcctggaaagaatccaagagccgtccaaacaaaacccggtctttttaaaactaacactggaaccataggcgccgtatctctggacttttcccctggaacgtcaggatctccaattgtcgacaaaaaaggaaaagttgtgggcctttatggcaacggtgtcgtcacaaggagtggaacatacgtgagtgccatagcccagactgaaaaaagcattgaagacaacccagagattgaagatgacatctttcgaaagaaaagactgaccatcatggacctccacccaggagcaggaaaaacaaagagataccttccagcaatagtcagagaagccataaaacgaggcttgagaacactaatcctggcccccactagagtcgtggcggctgaaatggaagaagctctcagaggacttccaataagatatcaaaccccagctatcagagctgagcatactggacgggagattgtggatctaatgtgtcacgccacatttaccatgaggctactatcaccaattagagtgccaaattacaacctgattatcatggatgaagcccatttcacagacccagcaagcatagcggctagaggatacatctcaactcgagtagagatgggtgaagcagctgggatttttatgacagccacccctcctggaagcagagacccatttcctcagagcaacgcaccaatcatggatgaagaaagggaaattcctgagcgttcgtggaactctggacatgagtgggttacggattttaaagggaagactgtttggtttgttccaagtataaaagcaggaaatgatatagcagcttgcctgagaaagaatgggaagaaagtgatacaactcagcaggaagacctttgattctgaatatatcaagactaggaccaatgattgggactttgtggtcacgacagacatttcagaaatgggtgctaacttcaaggctgagagggttatagaccccagacgctgcatgaaaccagtcatactaacagacggtgaagaacgggttatcctggcaggacccatgccagtgacccactctagtgcagcacaaagaagagggagagtaggaagaaatccaaaaaatgaaaatgaccagtatatatacatgggggaacctctggaaaatgatgaagactgcgcacactggaaagaagctaagatgcttctagataacatcaacacgcctgaaggaatcattcccagcatgtttgaaccagagcgtgagaaggtcgacgccattgatggtgaataccgcttgagaggagaagcgaggaaaacatttgtggacctaatgagaagaggagacctaccagtttggctagcctacagagtggcagctgaaggtatcaactacgcagacagaagatggtgctttgatggagtcaagaacaaccaaatcttggaagaaaatgtggaagtggaaatttggacaaaagaaggagaaaggaagaaattaaaacccagatggttagatgctaggatctactctgacccactggcacttaaagaattcaaggaattcgcagctggaagaaaatccctgaccctgaatctaatcaccgagatgggtaggctcccaaccttcatgacccagaaagcaaggaatgcattggacaacttagcagtcctacacacggctgaagcaggcggaagggcgtacaatcatgctcttagtgaactgccggagactctggagacattgcttttactgacacttttggccacagtcacaggcggaatcttcctgttcttgatgagcggaaagggtatagggaagatgaccctgggaatgtgctgcatagtcacagccagtattcttctatggtatgcacaaatacagccacattggatagcagcttcaataatactggagttttttctcatagtcttgctcattccagaaccagaaaagcagagaacaccccaagataaccaattgacttatgttgtcatagccatccttacagtggtggccgcaaccatggcaaatgagatgggtttcctggaaaaaacaaagaaagatttcggattgggaagcatcacaacccagcaacctgagagcaacatcctggacatagatctacgtcctgcatcagcttggactctatatgctgtggcaacaactttcatcacaccaatgttgagacatagcattgaaaattcctcagtgaatgtgtctctaacagccattgccaaccaagccacagtgttaatgggtcttgggaaaggatggccattgtcgaaaatggacatcggagttccccttctcgctatcggatgctattcacaagtcaaccccataaccctcacagcagcccttctcttattggtagcacattatgctatcatagggccaggactccaagcgaaagcaaccagagaggctcagaaaagagcagcagcgggcatcatgaaaaacccaactgtggatggaataacagtgattgacctagatccaataccatatgatccaaagtttgaaaagcagttgggacaagtaatgctcttagtcctctgcgtgactcaagtattgatgatgaggactacatgggctttatgtgaagctctaactttagcgaccgggcccatctctacactgtgggaaggaaatccagggagattttggaatacaactattgcagtgtcaatggctaacatttttagagggagttacctggccggagccggacttctcttttctatcatgaagaacacggccaacacaagaaggggaactggcaacacaggagaaacgcttggagagaaatggaaaaaccggttgaatgcattggggaagagtgaattccagatctataagaaaagtggaatccaggaagtggatagaacgttagcaaaagaaggcatcaagagaggagaaacggaccatcacgctgtgtcgcgaggctcagcgaaactgagatggttcgtcgagagaaaccttgtcacaccagaagggaaagtagtggaccttggctgcggcagggggggctggtcatactattgtgggggactaaagaatgtaaaggaagtcaaaggcctaacaaaaggaggaccaggacacgaagaacccattcccatgtcaacatatggttggaatctggtgcgtctgcaaagtggagtcgatgtcttttttactccgccagaaaagtgtgacacattgctgtgtgacataggggaatcgtcaccaaaccccacggtcgaggcaggacgaacactcagagttctaaacttagtggaaaactggctgaacaataatacccaattttgcataaaggttcttaatccatatatgccttcagttatagaaaaaatggaagcactacaaaggagatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaggccacatacgagccggatgttgatctcggaagtggaacccgcaacatcggaattgaaagtgaagtaccaaatctagacataattgggaaaagaatagaaaaaataaaacaagagcatgaaacatcatggcactatgatcaagaccacccatacaaaacgtgggcctaccatggcagctacgaaacaaaacagactggatcagcatcatccatggtgaacggagtggttaggctgctaacaaaaccttgggacgtcatccccatggtgacacagatggcaatgacagacacgactccatttggacaacagcgcgttttcaaagagaaagtggacacgagaacccaagaaccaaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaagctgttgaagacagtggattttgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggcttggagcacgcttcttggagtttgaagccctgggattcttgaatgaagatcactggttttccagagagaactccctgagtggagtagaaggagaagggctgcacaaactaggctacattctaagagacgtgagtaagaaagaaggaggagcaatgtacgccgatgacaccgcaggatgggacacaagaatcacgctagaggacttgaaaaatgaagaaatggtgacaaaccacatggaaggagaacacaagaaacttgctgaagccattttcagattaacgtaccaaaacaaagtggtgcgtgtgcaaagaccgacaccaagaggcacagtaatggacattatatcgagaagagaccaaagaggtagtggacaagttgtcacctacggcctcaacactttcaccaacatggaagcccaactgatcagacagatggagggagaaggagtcttcaaaagcatccagcacctgacagccacagaagaaattgcagtgaaaaactggttagtaagagtggggcgtgagaggttatcaagaatggccatcagcggagatgattgtgttgtgaaacccttcgatgacaggtttgcaaacgctctaacagctttaaatgacatgggaaaggtcaggaaagacatacaacaatgggaaccttcaagaggatggaacgattggacacaagtgcccttttgttcacaccatttccatgagttaatcatgaaggacggtcgtgtacttgtggttccatgtagaaaccaagatgaactgattggtagggcccgaatttcccagggagccgggtggtccttgcgggaaacagcttgtttggggaagtcttacgcccaaatgtggagcctaatgtacttccacagacgtgaccttaggctggcggcaaacgctatttgctcggcagtcccttcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaagaaatcccatatttggggaagagagaagaccagtggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7132 - RNA, 9873 nt, synthetic construct
  misc_feature 1..9873: note = derived and/or modified CDS sequence (wt) from DENV-2__KX274130__SS-prME
  source 1..9873: mol_type = other RNA
tctgcagctacactactcttgttggttccaacaattatggcttttcacctgacgacacgaaacggtgagccgcacatgatagtggcccgccatgaaaaagggaagagcctgatattcaagacagagaatggggtgaacatgtgcacattaatggctatggacctaggagaactgtgtgaggaaacagttacatacaaatgcccatacttgaagcaaagtgaaccagaagacatagactgctggtgcaacacaacatccacctgggttacatatggaacatgcagctcatcaggagaacacagaagggaaaaaagatcagtggccctcgccccgcacgtgggcatgggactggaaaccagaacagaaacatggatgtcctcagaaggagcatggaaacatgcccagcgaattgaaaactggatattacggcacccagggtatacagtcatggcggccgctattgcaatggccattggaaccaacaatttccaaagggcactgatattcgtgctattgacagctgtggctccatcaatgacaatgcgctgcgtgggcattgccaacagagacttcgttgagggggtttcgggtggaagctgggttgacattgtcttggaacatggaagctgtgtaacaacaatggcaaagaacaaacccacattggactttgagttgacaaagacagaagccaaactaccagccactttgcggaaatactgcatagaggctaagctcacaaataccactactgaatcaagatgcccaacacagggagaacccagcctaccagaagaacaagacaaaagattcatatgtagacactcactagtggatagaggctggggcaatggatgtggtttatttggaaagggtgggatagtgacatgtgccatgtttacatgcaagaaatacatggaggggaaaatagtccaaccagaaaacctggaatacacagtcgccgtaacaccacactcaggggaggaacactcagtaggcaatgacacaggaaagcacggacaagacgtgaaaataacaccccagagctcaatcacagaaacagccctagaaggatatggttccatatcaatggaatgttcaccaaggacaggcctcgacttcaatgaaatggtgctgctgcagatggaggacaaggcatggctagtacacaggcaatggttcttggacctccccctaccctggcttccaggctcagacacacaagggtcaaattgggtgcaaaaggaaactctggtgacattcaagaatccacatgccaaaaaacaagacgtagtagtgttaggctcacaagaaggagcgatgcattcagctttaacaggagctacagaaatccaaatgacttctggaaaccttctgttcacaggacacttgaaatgcaggctgcgaatggacaaactagaactcaaaggaatgtcttactcaatgtgcactggaaagttcaaagtagtgaaggagatcgcagagactcagcatggaacaatagtaattagagtacagtatgaaggagagggaagcccatgtaagataccttttgagatcatggacttagaaaagaaacatgtcctaggacggttaataactgtcaaccccatcatcacagagaaagacaaaccaacaaacatagaggccgaaccgccctttggtgacagctacattttgattggagttgaaccaggacagctaaaaatgaattggtttaaaaaagggagtagcatcggccaaatgttcgagactacaatgagaggagcaaaaagaatggcaatattgggagacacagcatgggactttggctcactagggggagttttcaactccataggaaaagcccttcaccaagtctttggagcagtgtacaacgccgccttcagtggagtgtcatggactatgaaaatattaattggagttattataacatggataggaatgaactcccggagcacctcaatgtcaatcacattagtcatggtgggactagtaacattatacctaggggtagtagttcaagcggacagtgggtgtgtggtcagctggaagactaaagaactgaaatgtggcagtggaatttttgtgaccgacaatgtgcacgtgtggactgagcaatacaaattccaacccgagtcgccagccaaacttgcagctgctattaaaaaagctcatgaggaaggtgtttgcggtataagatcagttacaaggctagagaacataatgtggaaacaaataaccccagaactaaatcacatcctaactgagaatgacgtgaaggttaccatcatgactggggatattaagggaattttgcagcaaggtcgacgagcactgagaccgcaaccaacagaattaaaatattcatggaaaagttggggaaaatcaaaaatagttagctcagaaacacataaccaaacttttttaatagatggaccagaaaccacagaatgtccagacaccaatcgagcgtggaactctttggaagttgaggactatggatttggattgttttcaacgaacatttggctacgtctcagagaaaagcaagacacactatgtgattcaaagctcatgtcagcagcggtgaaagacgagagagccatccacgcagacatggggtattggatagaaagcaaactcaatggcagctggaagatagagaaagcatcctttctagaggtgaaaagctgcacatggccacgctcccacactttatggagcaatggagtgttggagagtgaaatgataataccaaaaaatttaggtggaccagtatcacaacacaattatagacctggctattacacacagaccacaggaccttggcacttggggaaattagaaatggactttgattattgtgaagggacaacagtgatagtcacagaagagtgcaacaatagagggccatccctacgcacaacaacagcctcagggaagttgataacagaatggtgctgcagatcttgcacaatgccccccttgagattcaaaggtgaagatgggtgctggtatggaatggagattcgacctttaaaagagaaagaagaaaatctcgtcaattcgctagttactgcaggacatgggcagattgacaacttttcattagggattcttggaatagcgttgtttttagaagaagtcatgaagagtagaatcggaatcaaacacacaataggaatgacaattataactttcctgctgttagtaacgggaaatgtgtcctaccgtgacttgggcagagtgatactgatggtaggctcaactatggcagacgaaatggggatgggggttacgtacttagccctcctcgctaccttcagaataagaccaacttttgctttggctcttatgataaggaagctcacgtcaaaagaactactcatggccacaattggaattgtcctcatagctcagtgcgacgtcccagggacaatcttggaaataacagatgcttgtgcactgggcttaatgttactaaaaatgaccagagaattggaaaggtaccagttggcagtgacattgttgtcattgacatgcataccaaatgcgacaataatgtggggagcgtggaaggtcacatgcacaatcctgacactggtttccatggcccccctttttctgacaacatccaggcaaaaaacagactgggtaccggtcgcattatcaatctatggtttaaatccaacagcaatatacttcacaacattagcgaaggcgaagaaaataaggagctggccgctaaatgaagctgtgatggcagtgggaatggtgagcatattagcaagttcactgctgagaaatgacataccaatggcaggaccactagttgctggagggttgctgactctctgctacgtgctgaccgggaggtcagctgatctagaacttgagaagtccgctgacatcaaatggaatgatgacgcggaaatttcaggaagcagcccgataataaatgtggctgtatcagaagatggtagtatgtcaataaaagatgaggaagaagaaaacaccctcaccatactgatccgcacaggccttttagctatctcaggaatgtacccaatggctataccagcaacggccgccgtgtggtatttttgggaggcaagaaagcagcgagccggagttttgtgggatgttccaagtcccccaccaacagggaaagcagaactggaagagggagcctaccgcatcaaacaacgaggtatttttggatactcacaaataggagcaggagtgtacaaagaaggaaccttccacacaatgtggcacgtgacaagaggatcagtgctcatgtgcaaagggaaaagactagaaccatcatgggctgatgtaaagaaagacttaatctcatacggaggtggatggagactggatggagagtggactgaaggtgaggaagtccaagtgctagcgttggaaccagggaaaaatcctagggccgtacaaacaaaacccggcatgttcaaaactgacacaggaagaattggtgctgtgtcattggactttgctccaggaacctcaggatcccccatcatagacaaaaaagggaaagtgattggactttatgggaatggagtggtgatgaaaagtggggcctatgtgagctccatagctcaaactgaaaaaagagaagatgaaatacctgaaatagaagatgatatcttcagaaagagaagactcacaataatggatttacatccaggggccggaaaaacaaaacgctacctcccagcaatagtacgtgaagctataaagagaggtctaagaactctgatcctagcccccacaagggtggtggcagctgaaatggaagaagcgctcagggggttgccaatacgttaccagaccccggcaatcagagccgagcatacaggcagggaaattgtggatcttatgtgtcatgccacattcacgatgcgtctactgtctccagtaagagtgcccaactacaacttaatcataatggatgaagcccactttacagatcccgccagcatagctgctagaggctacatagcaaccagagtggaaatgggagaggctgccggaatcttcatgacagccactcctcccggaagcaaggacccttttccgcagagcaacgctccaataatggatgaagagcgcgaaattccagaacgctcttggaactcaggtcatgagtggataacagactttgaagggaaaacagtgtggtttgttcccagcataagagcagggaatgatatcgcaacatgtttgaggaagaatgggaaaaaggtgatccagctaagtcgtaaaacttttgacaccgaatacatcaaaacacgcaacaatgactgggactttgtcgtcacaacagacatatctgagatgggggcaaacttcaaggccgaaagagtcatagacccaagaaggtgcatgaagcccgtaattctcactgatggagaggaaagagtcattcttgcaggaccgatgccagtgacaccatcgagtgcggcacagagaaggggcagaatagggagaaatccgaagaatgaaaacgatcagtacatatacatgggagaaccactagaaaatgatgaagactgcgcccattggaaagaagcaaagatgctccttgacaacatcaacacacccgaagggataataccagcaatgttcggtcctgagagggaaaaaactgatgccatagacggagaataccgtctaagaggagaatccaggaaaacatttgttgaactcatgagaagaggagaccttccagtgtggctggcatacaaggtggcatcagaagggtacagttatgcggataggagatggtgctttgaaggagtgaaaaacaaccaaatactggaggagaaccttgaggtggagatttggacaaaagaaggagagaggaaaaaactgagaccaaagtggctggatgcgcgaacatattcagatccacaggcattgaaagatttcaaggaattcgccgcagggcggaagtctaccacactcaacctaattgcggagcttggccgtttaccaacgtatatgacacagaaaacgagagatgccctggataacttggcagttttgcacacagcagaagaggggggaagggcttaccagcacgcaatcagtgaactcccagaaacactagaaacactattgttgctctgcctactggccacagtttcagggggggtctttctttttctgatgagtgggaaaggaattggtaagatgtcaatgggacttggatgcatcatcacagccagtgggctcctttggtatgcccaaatccagccacactggattgcagcctctataatactagagttctttctgattgtattgctgatccctgaaccggaaaaacaaagaactccacaagataaccagctcacatacgtggtcatagcaatactaacgctagtagcagcaaccatggcaaatgaaatgggttatttggaaaagaccaaaaaagatctgggatttggaaacccatatgttgcctcacatgaagcagctattctggacatagatctacatccagcttcagcctggacattgtatgcagtggccacaacactaatcacacccatgctacgacacagtattgaaaactcttcaaccaatgtttcattgacagctatagccaaccaagccactgtcttgatgggacttggaaaaggatggccattgtcaagaatggacttaggggtgcctttactggctctgggatgttattcacaagttaacccactgaccctgactgcttcccttttacttttaatagggcactatgcaataataggaccgggtctgcaagctaaggcaacgagagaagctcaaaagaggacagcggccggaatcatgaaaaatccaacagtggatggaataacagttatagacattgaaccaattccatacgacccaaagtttgaaaaacaactaggacaggtaatgctcttggttctctgcgtggcccaggtgttgatgatgagaacgacatgggctatgtgtgaagcattaacaatagcaacgggccctatatcaacattatgggaaggaaaccctggaaaattctggaacacaacaatagcagtatccatggctaatatattcagaggaagttacctggcaggagcaggacttctattctccataatgaaaaacacagtcactggaagacggggaactggagtggccggagagactcttggagagaaatggaaaatcaaattaaatggattagggagaacggattttcagacatacaaaaggagtggcataattgaagtggacagaacactagccaaagaaggtatcaagagaggagaaaccaaccaccacgcagtgtcgaggggttcagcgaaactgagatggttcgtggagagaaatctagtgaaaccagaaggcaaagtaattgacctgggctgtggtagaggaggctggtcttactattgtggaggtctaaaaaatgtaaccgaagtgaaaggtctgacgaaaggaggtccaggacatgaagaacccatcccaatgtcaacttacggatggaatctcgtacggctacaaagtggcgtggatgtgttttttacacctccagagaaatgtgacactttgctgtgtgatataggagaatcatcaccaaatccaaccatcgaagccgggagaacacttagggttttgaatatggtagaaaattggctgggcaacaatcaattctgcataaaagtactcaacccatacatgccatctgtgattgagaagatggaaaacttgcaaaggaagttcggtggaacactggtgagaaacccactctcacgaaactcaacacatgaaatgtactgggtgtccaatgctagtggaaacatagtatcttctgtcaatatgatctccagaatgctcatcaacaggttcaccatgaaacataaaaaaccgacatatgaacaggatgtggatctaggcagtggaacaagaaatgtgggcattgagaccgaaaaacccaatcttgaaattatagggaagagaattgagaaaataaaagatgagcacaagcagacatggcattatgacctggaccacccgtacaagacatgggcctatcatgggagttatgaaacaaagcaaactggatcagcctcttcgatgatcaatggcgtagtaaaactcctcacaaaaccatgggatgtgattcccatggtgacccagatggcaatgacagacacaacaccatttggacagcaaagagtcttcaaggaaaaagttgatacaagaactccagaacccaaagaaggaacaaagaaactcatgaagttgacggcaaagtggctgtgggcggaactgggaagacacaaagtgcctaggatgtgcacaagagatgaattcacaaacaaggttaggagcaatgcagccatgggagcagtttttactgaagaaaatagatggagctcagcaaaagaagctgtggaggatgaagccttctgggatctcgtagatagagagagaaagctacacttgcaaggaaagtgtgagacgtgtgtctacaacatgatggggaaaagagaaaagaaactaggagagtttggaagggcaaagggtagccgggccatctggtacatgtggctaggagcaagatttctggaattcgaagcactcggcttcctcaatgaagatcattggttttccagggagaattcactcagtggagtagaaggagaagggctgcacaaactgggatacatccttagagaaattggggcaaaagatggaggaatgatgtacgcagatgacacagccggatgggacacacgtgtcacagaagaagatttaaagaatgaagagatgatatcggaacagatgaaaggtgagcataggacactggctgaggctattttcaaattaacctaccaaaacaaagtagtcagagtccaacgtcccaccccgaaaggcacagtgatggacatcatttcacgcagagaccaacgtggaagtggacaagtaggcacctatggattaaacacttttaccaacatggaagcacagctcattaggcaaatggaaggggaaggtctgttcagggacatatctaaattgaccatccaggaagaaacagctatccttacctggctgaaggaaaaagggcgtgatagactgagtcgtatggccatcagtggagatgattgtgtggtcaaaccagttgatgacaggttcgcccatgccctcacagccctgaatgacatggggaaagtaaggaaagacatacaacaatgggaagcatccaagggttggaatgactggacacaagtccccttttgctcacaccatttccatgagataatcatgaaagacgggagaaaactggtggtcccctgccgaaaccaagatgaactcatagggagagctagaatctctcaaggggctggatgggcattgaaagagacagcctgtctagggaaagcctatgcacaaatgtggagccttatgtacttccaccgaagagatctaagactagcagcaaatgccatttgctcagctgtcccatcccactgggttccgacaagtcgaaccacttggtccatccatgcacatcatcaatggatgacaactgaggacatgctagacgtatggaacagagtgtggatactggaaaacccttggatggatgacaaaacttgcgtgaagtcatgggaggaagttccgtacttagggaaaagagaggaccaatggtgtggctcactcataggattgaccagcagggcaacatgggcaaagaacataaaagtggcaattgagcaagtgagatccttaatagggaaagaagaatacactgactacatgccctccatgaaaaggttcaagcaggaacagagcacagaaggagcactgtggtga

SEQ ID NO: 7133 - RNA, 9876 nt, synthetic construct
  misc_feature 1..9876: note = derived and/or modified CDS sequence (wt) from DENV-2__GU289914__SS-prME
  source 1..9876: mol_type = other RNA
tctgcaggcatgatcattatgttgattccaacagtgatggcgttccatctaaccacacgtaacggagaaccacacatgatcgtcagtagacaagagaaagggaaaagtcttctgtttaaaacagaggatggtgtgaacatgtgcaccctcatggccatggaccttggtgaattgtgtgaagacacaatcacgtacaactgtccccttctcaggcagaatgagccagaagacatagactgttggtgcaactccacgtccacatgggtaacttatgggacttgtactaccacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcagcaatcctggcatataccatagggacgacacatttccagagagccctgattttcatcttactgacagctgtcgctccttcaatgacaatgcgttgcataggaatatcaaatagagactttgtagaaggggtttcaggaggaagctgggttgacatagtcttagaacatggaagctgcgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggattgtttgggaagggaggcattgtgacctgtgctatgtttacatgcaaaaagaacatggaaggaaaagttgtgcaaccagaaaacttggaatacaccattgtggtaacacctcactcaggggaagagcatgcggtcggaaatgacacaggaaaacatggcaaggaaatcaaagtaacaccgcagagttccatcacagaagcagaattgacaggctatggcactgtcacgatggagtgctctccgagaacaggcctcgacttcaatgagatggtgttgctgcagatggaaaacaaagcttggctggtgcacaggcaatggttcctagacctgccgttaccatggctgcccggagcggatacacaagggtcaaattggatacagaaagaaacattggtcactttcaaaaatccccatgcgaagaaacaggatgttgttgttttaggatcccaagaaggggccatgcacacagcactcacaggggccacagaaatccaaatgtcatcaggaaatttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgtaaaatcccttttgagataatggatttggaaaaaagacatgtcttaggtcgcctgatcacagtcaacccaattgtgacagaaaaagatagcccagtcaacatagaagcagaacctccattcggagacagctacatcatcataggagtagacccgggacaactgaagctcaactggtttaagaaaggaagttctatcggccaaatgtttgagacaacaatgaggggggcgaagagaatggccattttgggtgacacagcctgggattttggatccctgggaggagtgtttacatctataggaaaagctctccaccaagtctttggagcaatctatggagccgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtggaatccgctcagtaacaagactggagaatctgatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccgaaacagcagaatgccccaacacaaatagagcttggaattcgttggaagttgaagactacggctttggagtattcaccaccaatatatggctaaaattgaaagaaaaacaggatgcattctgcgactcaaaactcatgtcagcggccataaaagacaatagagccgtccatgccgatatgggttattggatagaaagtgcactcaatgacacatggaagatagagaaagcctctttcattgaagttaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaactacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaagagaaagaagaaaatttggttaactccttggtcacagccggacatgggcaggttgacaacttttcactaggagtcttgggaatggcattgttcctggaggaaatgcttaggacccgagtaggaacgaaacatgcaatactactagttgcagtttcttttgtgacattgatcacagggaacatgtcctttagagacctagggagagtggtggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccaaagcaccataccagagaccattcttgaattgactgatgcgttagccttgggcatgatggtcctcaaaatggtaagaaatatggaaaagtatcaattagcagtgactatcatggctatcttgtgcgtcccaaacgcagtgatattacaaaacgcatggaaagtgagttgcacaatactagcagtggtgtccgtttccccattgcttttaacatcctcacagcaaaaaacggattggataccattagcattgacaatcaagggtctcaacccaacagctatttttctaacaaccctctcaagaaccagcaagaaaaggagctggccattaaatgaggctatcatggcagtcgggatggtgagcattttagccagttctctcctaaaaaatgatattcccatgacaggaccactagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcaataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaatcaagcaaaaagggattcttggatattcccagatcggagccggagtttacaaagaaggaacattccatacaatgtggcatgtcacacgtggcgctgtcctaatgcacaaaggaaagaggattgaaccatcatgggcggacgtcaagaaagatctaatatcatatggaggaggctggaagttagaaggagaatggaaggaaggagaagaagtccaggtattggcattggagcctggaaaaaatccaagagccgtccaaacaaaacctggtcttttcagaaccaacgccggaacaataggtgccgtatctctggacttttctcctggaacgtcaggatctccaatcattgacaaaaaaggaaaagttgtgggtctttatggtaatggtgttgttacaaggagtggagcatatgtgagtgctatagcccagacagaaaaaagcattgaagacaacccagagatcgaagatgacattttccgaaagagaagactgaccatcatggacctccatccaggagcgggaaagacgaaaagataccttccggccatagtcagagaagctataaaacggggtttgagaacattaatcttggctcccactagagttgtggcagctgaaatggaggaagctcttagaggacttccaataagataccaaaccccagccatcagagctgagcacaccgggcgggagattgtggacctaatgtgtcatgccacatttaccatgaggctgctatcaccagttagagtgccaaactacaacctgattatcatggacgaagcccatttcacagacccagcaagtatagcagccagaggatacatctcaactcgagtggagatgggtgaggcagctgggattttcatgacagccactcccccgggaagcagagacccatttcctcagagcaatgcaccaatcatagatgaagaaagagaaatccctgaacgttcgtggaattctggacatgagtgggtcacggatttcaaagggaagactgtttggttcgttccaagtataaaagcaggaaatgatatagcagcttgcctgagaaaaaatggaaagaaagtgatacaactcagtaggaagacttttgattctgagtatgtcaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcatccctagcatgttcgaaccagagcgtgaaaaagtggatgccattgatggcgaataccgcttgagaggagaagcaaggaaaacctttgtagacttaatgagaagaggagacctaccagtctggttggcctacaaagtggcagctgaaggcatcaactacgcagacagaaggtggtgttttgatggaatcaagaacaaccaaatcttggaagaaaacgtggaagttgaaatctggacaaaagaaggggaaaggaagaaattgaaacccagatggctggatgctaggatctattctgacccactggcgctaaaagaatttaaggaatttgcagccggaagaaagtctctgaccctgaacctaatcacagaaatgggtaggcttccaacctttatgactcagaaggcaagagacgcactggacaacttagcagtgctgcatacggctgaagcaggtggaagggcgtacaatcatgctctcagtgaactgccggagaccctggagacattgcttttactgacactgctggctacagtcacgggagggatctttttattcttgatgagcgggaggggcatagggaagatgaccctgggaatgtgctgcataatcacggctagcatcctcctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtatccctaacagctatagccaaccaagccacagtgttaatgggtctcgggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagggaagctcagaaaagagcagcggcgggcatcatgaaaaatccaaccgtcgatggaataacagtgattgacctagatccaataccctatgatccaaagtttgaaaagcagttgggacaagtaatgctcctagtcctctgcgtgactcaagtattgatgatgaggactacatgggctctgtgtgaggctttaaccttagctaccgggcccatctccacactgtgggaaggaaatccaggaagattttggaacactaccattgcggtgtcaatggctaacatttttagagggagttacttggctggagctggacttctcttttctattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggttcagcaaaactgagatggttcgttgagagaaacatggtcacaccagaagggaaagtagtggacctcggttgtggcagaggaggctggtcatactattgtggaggactaaaaaacgtaagagaagtcaaaggcctaacaaaaggaggaccaggacacgaagaacccatccccatgtcaacatatgggtggaatctagtgcgtcttcaaagtggagtcgacgttttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagtcatagaaaaaatggaaacactgcaaaggaaatatggaggagccttagtgaggaatccactctcacgaaactccacacatgagatgtactgggtatctaatgcttccgggaacatagtgtcatcagtgaacatgatttcaaggatgttgatcaacagattcacaatgagacacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagacagtaggttttgggagctggttgacaaggaaaggaatctccatcttgaaggaaagtgtgaaacatgtgtgtacaacatgatgggaaaaagagagaagaagctaggggaattcggcaaggcaaaaggtagcagagccatatggtacatgtggcttggagctcgcttcctagagtttgaagccctaggattcctaaatgaagatcactggttctccagagagaactccctgagtggagtggaaggagaagggctgcacaagctaggttacattctaagagacgtgagcaagaaagagggaggagctatgtatgccgatgacacagcaggatgggacacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacattatatcgagaagagaccaaagaggtagtggacaagttggtacctatggactcaatactttcaccaatatggaagcccaactaatcagacagatggagggagaaggagtcttcaaaaacattcagcacctgacagtcacagaagaaatcgccgtgcaaaactggttggcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaacgattggacacaagtgcccttctgttcacaccatttccatgagctaatcatgaaagatggtcgcgtacttgttgttccatgtagaaaccaagatgaactgattggcagagcccgaatctcccaaggagcagggtggtctttgcgggagacggcctgtttggggaagtcctacgcccaaatgtggagcttgatgtacttccacagacgcgacctcaggctggcggcaaatgccatttgctcggcagtaccatcacattgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaggaatacacagattacatgccatccatgaaaagatttagaagagaagaggaagaagcaggagtcctgtggtag

SEQ ID NO: 7134 - RNA, 9876 nt, synthetic construct
  misc_feature 1..9876: note = derived and/or modified CDS sequence (wt) from DENV-2__AY858036__SS-prME
  source 1..9876: mol_type = other RNA
actgcaggtataatcattatgatgattccaacagtgatggcgttccatttaaccacacgcaacggagaaccacacatgatcgtcagtagacaagaaaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccgcatgtgggaatgggactggagacacgaactgaaacatggatgtcatcagaaggggcctggaaacatgcgcagagaattgaaacttgggtcttgagacatccaggcttcaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttggaacatggaagctgtgtgacaacgatggcgaaaaataaaccaacattggattttgaactgataaagacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaaaggaggtatcgtgacctgtgcaatgttcacatgcaaaaagaacatggaaggaaaaatcgtgcaaccagaaaacttggagtacaccattgtgataacacctcactcaggggaagagaatgcagtcggaaatgacacaggaaaacacggcaaggaaattaaagtaacaccacaaagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcacttttaaaaatccccatgcaaagaaacaggatgttgttgttttaggatcccaagaaggggctatgcacacagcactcacaggggccacggaaatccagatgtcatcaggaaacttactgttcacaggacatcttaaatgcaggctgagaatggacaaactacagctcaaaggaatgtcatattccatgtgtacaggaaagttcaaagttgtgaaggaaatagcagaaacacaacatggaacaatagtcatcagagtacaatatgaaggggacggttctccatgcaagatcccttttgaaataatggatttggaaaaaagacatgtcttaggtcgcttgatcacagtcaacccaattgtcacagaaaaagacagcccagtcaacatagaagcagaacctccattcggagacagctacatcattataggagtagagccgggacaactgaagctcagctggtttaagaaaggaagttctattggccaaatgtttgagacaacaatgagaggagcgaagagaatggccattttaggtgacacagcttgggattttggatccctgggaggagtgtttacatctataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggagtagtgacattgtatttgggagttatggtgcaggccgatagtggttgcgttgtgagttggaaaaacaaagaactgaaatgtggcagtgggatttttgtcacagacaacgtgcacacgtggacagaacaatacaaattccagccagaatccccttcaaaactggcttcagctatccagaaggcccatgaagagggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcggcctcaacccactgagctgaagtactcgtggaaaacatggggcaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaattgaaagaaaggcaggatgtattttgtgactcaaaactcatgtcagcagccataaaagacaacagagccgtccacgccgatatgggttattggatagaaagcgcactcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccatggcatctaggcaggcttgagatggactttgatttctgcgaaggaaccacagtggtggtgactgaggactgtggaaatagaggaccctctttaagaacaactactgcttctggaaaactcataacagaatggtgctgccgatcttgcacattaccaccgctaaggtacagaggtgaggatggatgttggtatggaatggaaatcagaccattgaaagagaaagaagagaacttggtcaactctttggtcacagccggacatggacagattgacaacttctcactaggagtcttgggaatggcattgttcctggaagagatgctcaggacccgagtgggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccgacttttgcagctggactactcttaaggaagctgacctccaaggaattgatgatgaccaccataggaattgtactcctctctcagagcaccataccagagactatacttgaactgactgacgcgttggctttagggatgatggttctcaaaatagtaagaaacatggaaaagtatcaactagcagtgaccatcatggctatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctcgcaagaactagcaagaaaaggagctggccactaaatgaggctattatggcagtcgggatggtgagcattttagccagttctctcttaaaaaatgatattcccatgacaggaccattagtggctggagggcttctcactgtgtgttacgtgctcactggaagatcggctgatttggaactggagagagctgctgacgtaagatgggaagaacaggcagagatatcaggaagcagtccaattctgtcgataacaatatcggaagatggtagcatgtcgataaaaaatgaagaagaagaacaaacactgaccatacttattagaacaggactgctggtgatatcaggactttttcccgtgtcaataccaatcacggcagctgcatggtacctgtgggaagtgaaaaaacaacgagccggagtgctgtgggatgtcccttcacctccacctgtgggaaaagccgaactggaagatggagcctatagaatcaagcagaaagggattctaggatactcgcagatcggagctggagtttacaaagaaggaacattccacacaatgtggcatgtcacacgtggtgctgttctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggcgccgtatctctggacttttctcctggaacgtcaggatctccaattgtcgacaaaaaaggaaaagttgtgggcctttatggcaacggtgtcgtcacaaggagcggaacatatgtgagcgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactggacgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccatttcctcagagcaacgcaccaatcatggatgaagaaagggaaatccctgagcgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgactctgaatatatcaagactaggaccaatgattgggactttgtggtcacgacagacatttcagaaatgggtgccaacttcaaggctgagagggttatagaccccagacgctgcatgaaaccagtcatactaacagacggtgaagaacgggtgatcttggcaggacccatgccagtgacccactctagtgcagcacaaagaagagggagagttggaagaaatccaaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggacgccattgatggtgaataccgcttgagaggagaagcgaggaaaacatttgtggacctaatgagaagaggagacctaccagtctggctagcctacagagtggcagctgaaggtattaactacgcagacagaaggtggtgctttgatggagtcaagaacaaccaaatcctggaagaaaatgtggaagtggaaatttggacaaaagaaggagaaaggaagaaattaaaacccagatggttggatgctaggatctactctgacccactagcgctcaaagaattcaaggaattcgcagctggaagaaaatccctgaccttgaatctaatcaccgagatgggtaggctcccaaccttcatgacccagaaagcaaggaatgcattggacaacttagcagtcctgcatacggctgaaacaggcggaagggcgtacaatcatgctcttagtgaactgccggagactctggagacattgcttttactgacacttttggccacagtcacgggcggaatcttcctgttcttgatgagcggaaaaggtatagggaagatgaccctgggaatgtgctgcataatcacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatcctcacagtggtggccgcaaccatggcaaatgagatgggtttcctagaaaaaacaaagaaagatttcggattgggaagcattacaacccagcaacctgagagcaacatcctggacatagatctacgtcctgcatcagcttggactctatatgccgtggcaacaactttcatcacaccaatgttgagacacagcattgaaaattcctcagtgaatgtgtctctaacagccattgccaaccaggccacagtgttaatgggccttgggaaaggatggccattgtcaaaaatggacatcggagttccccttctcgctatcggatgctattcacaagtcaaccccataactctcacagcagcccttctcttattggtagcacattatgctatcatagggccaggactccaggcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtactgatgatgaggactacatgggctttatgtgaagctctaaccttagcgaccgggcccatctctacactgtgggaaggaaatccagggagattttggaatacaactattgcagtgtcaatggctaacatttttagagggagttacctggccggagccggacttctcttttctatcatgaagaacacggccaacacaagaaggggaactggcaacacaggagagacgctcggagagaaatggaaaaaccggttgaatgcattggggaagagtgaattccagatctataagaaaagtggaatccaggaagtggatagaaccttagcaaaagaaggcatcaaaagaggagagacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagagcccattcccatgtcaacatatggttggaatctggtgcgtcttcaaagtggagttgatgtcttttttactccgccagaaaagtgtgacacattgctgtgtgacataggggagtcgtcaccaaaccccacggttgaggcaggacgaacactcagagttctaaacttagtggaaaactggctgaacaacaacacccaattttgcataaaggttctcaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagacgttgatctcggaagtggaacccgcaacatcggaattgaaagtgagacaccaaatttagacataattggaaaaagaatagaaaaaataaaacaagagcatgaaacatcatggcactatgaccaagaccacccatacaaaacgtgggcctaccatggcagctatgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggtacgaaaaaactaatgaaaatcacggcagaatggctctggaaagaactaggaaagaaaaagacacctaggatgtgcaccagagaagaattcacaagaaaggtgagaagcaatgcagccttaggtgccatatttactgatgagaacaagtggaagtcggcacgtgaggctgttgaagacagtgaattttgggaattggttgacaaggaaaggaatctccatcttgaaggaaagtgtgagacatgtgtgtataacatgatgggaaagagagagaagaagttaggggagttcggcaaagcaaaaggcagcagagccatatggtacatgtggcttggagcacgcttcttagagtttgaagccctaggatttttgaatgaagatcactggttttccagagagaactccctgagtggagtggaaggagaagggctgcacaaactaggctacattttaagagacgtgagtaagaaagaaggaggagcaatgtacgccgatgacactgcaggatgggacacaagaatcacactagaggacttaaaaaatgaagaaatggtgacaaaccacatggaaggagaacataagaaacttgctgaagccattttcagattaacgtaccaaaacaaggtggtgcgtgtgcaaagaccgacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcacctgacagttacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttctagaggatggaacgattggacacaagtgcccttttgttcacaccatttccatgagttaatcatgaaggacggtcgtgtacttgtagttccatgtagaaaccaagatgaactgattggtagggcccgaatttcccagggagccgggtggtccttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaatccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 7135 - RNA, 9876 nt, synthetic construct
  misc_feature 1..9876: note = derived and/or modified CDS sequence (wt) from DENV-2__HQ332184__SS-prME
  source 1..9876: mol_type = other RNA
acagcaggcgtgatcattatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccctcaatgacaatgcgctgcataggaatatcaaatagagacttcgtggaaggggtttcaggagggagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggaaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagaatacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccattttaggtgacacaggctgggactttggatccctgggaggagtgttcacatctataggaaaggctctccaccaagttttcggagcaatctatggggctgcttttagtggggtctcatggaccatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcacgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggcaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccctggtcacagccggacatgggcagattgacaacttttcactaggagtcttgggaatggcactgttcctggaagaaatgctcaggacccgagtaggaacgaaacatgcaacactgctagttgcagcatcttttgtaacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttatgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagttagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaaaaaaagattgaccatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcttgtctcaggaaaaatggaaagaaagtgatacaactcagtaggaaaacttttgactctgagtatgttaagactagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccattggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctattgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagtttttcctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcctatgcgtgactcaagtattaatgatgaggactacatgggctttgtgtgaggctttaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatcttggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgcgaggctgttgaagatggtaggttttgggagctggttgacaaggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaatgattggacacaagtgcctttctgttcacaccattttcatgagttagtcatgaaagatggccgcgtgctcgtagtcccatgcagaaaccaagatgaactgattggtagagcccgaatttcccagggagccgggtggtctttgaaagagacggcctgtttggggaagtcttacgcccaaatgtggaccctgatgtacttccatagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 7136 - RNA, 9876 nt, synthetic construct
  misc_feature 1..9876: note = derived and/or modified CDS sequence (wt) from DENV-2__HQ332185__SS-prME
  source 1..9876: mol_type = other RNA
acagcaggcgtgatcattatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaactgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccctcaatgacaatgcgctgcataggaatatcaaatagagacttcgtggaaggggtttcaggagggagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagaatacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccattttaggtgacacagcctgggactttggatccctgggaggagtgttcacatctataggaaaggctctccaccaagttttcggagcaatctacggggctgcttttagtggggtctcatggaccatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaattaaagaactgaaatgtggcagcgggatcttcatcacagataacgtacacacatggacagaacaatataagttccaaccagaatccccttcaaaactagcttcagctatccaaaaagctcacgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcgaaaatgctctccacagagtctcacaatcagacttttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaaaacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccctggtcacagccggacatgggcagattgacaacttttcactaggagtcttgggaatggcactgttcctggaagaaatgctcaggacccgagtaggaacgaaacatgcaatactgctagttgcagtatcttttgtaacattgatcactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttggccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttatgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagttagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaaaaaaagattgaccatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcttgtctcaggaaaaatggaaagaaagtgatacaactcagtaggaaaacttttgactctgagtatgttaagaccagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctattgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcctatgcgtgactcaagtattaatgatgaggactacatgggctttgtgtgaggctttaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagccgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatcttggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagttgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgcgaggctgttgaagatggtaggttttgggagctggttgacaaggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgatatgggaaaagttaggaaagatatacaacaatgggaaccttcaagaggatggaatgattggacacaagtgcctttctgttcacaccattttcatgagttagtcatgaaagatggccgcgtgctcgtagtcccatgcagaaaccaagatgaactgattggtagagcccgaatttcccagggagccgggtggtctttgaaagagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattaattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 7137 - RNA, 9876 nt, synthetic construct
  misc_feature 1..9876: note = derived and/or modified CDS sequence (wt) from DENV-2__HQ332186__SS-prME
  source 1..9876: mol_type = other RNA
acagcaggcgtgatcgttatgttgattccaacagcgatggcgttccatttaaccacacgcaatggagaaccacacatgatcgttggcaggcaggagaaagggaaaagtcttctgttcaaaacagaggatggtgttaacatgtgtaccctcatggccatagaccttggtgaattgtgtgaagacacaatcacgtacaagtgtcctctcctcagacaaaatgaaccagaggacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtggaaggggtttcaggaggaagctgggttgacatagtcttagaacatggaagttgtgtgacgacgatggcaaaaaacaaaccaacattggattttgaactgataaaaacagaagccaaacaacctgccactctgaggaagtactgtatagaagcaaagctgaccaacacaacgacagaatcgcgttgcccaacacaaggggagcccagcctaaatgaagagcaggacaaaaggttcatctgcaaacactccatggtagacagaggatggggaaatggatgtggattatttggaaagggaggcattgtgacctgtgctatgttcacatgcaaaaagaatatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacttgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagagtacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagctccatcggccagatgttcgagacaacaatgagaggagcaaagagaatggccattttaggtgacacagcctgggattttggatccctgggaggagtgttcacatctataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggagtcgtgacactgtacctgggagctatggtgcaggctgatagtggctgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtgaagttgaccattatgacaggagacactaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctctttcattgaagttaaaagctgccactggccaaagtcacacaccttctggagcaatggagtattagaaagtgagatgataattccaaaaaattttgccgggccagtgtcacaacacaactacagaccaggttaccatacacaaatagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacccctaagatacagaggtgaggatggatgctggtacgggatggaaatcagaccattgaaagagaaagaggagaatttggtcaactctttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagctagttctctcctaaaaaatgatattcccatgacaggcccattagtggctggagggcttcttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaaaaaaagattgaccatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcagggaatgatatagcagcttgtctcaggaaaaatggaaagaaagtgatacaactcagtaggaaaacttttgactctgagtatgttaagactagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaacgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtataatcatgctctcagtgaactgccggagaccctggagacactgcttctactgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagagaaacagagaacaccccaagacaaccaattgacctacgttgtcatagccatcctcacagtggtggccgcaaccatggcaaatgagatgggtttcctggaaaaaaccaagaaagacctcggattgggaagcatcacaacccaggaacctgagagcaacatcctagacatagatctacgccctgcatcagcatggacgctgtatgccgtggctacaacatttgtcacaccaatgttgagacatagcattgaaaattcctcagtgaatgtctctctaacagccattgctaaccaagctacagtgctaatgggtcttgggaaaggatggccattgtcaaagatggacatcggagttcccctccttgccattggatgctactcacaagtcaaccctataactcttacagcagctcttcttttattggtagcacattatgccattatagggccaggactccaagcaaaagcaaccagagaagctcagaaaagagcagcagcaggcatcatgaaaaacccaacagttgatggaataacagtgattgacctagaaccaataccctatgatccaaaatttgaaaagcagttaggacaagtaatgctcctaatcctatgcgtgactcaagtattaatgatgaggactacatgggctttgtgtgaggctctaaccttagcgaccgggcctatctccacactgtgggaaggaaatccagggaggttttggaacactaccattgcagtgtcaatggctaacatctttagagggagctacttggccggagctggacttctcttttccatcatgaaaaacacaacaaacacaagaagaggaactggcaacataggagagacacttggagaaaaatggaaaagtcgattaaacgcactggggaaaagtgaattccagatctacaagaaaagtggaatccaggaagtagatagaaccctagcaaaagaaggcatcaaaagaggagaaacggaccaccatgctgtgtcgcgaggttcagcaaaactgagatggttcgtcgagagaaacatggtcacaccggaggggaaggtggtggatctcggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaattccacgcatgaaatgtactgggtatctaatgccaccggaaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacacatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgcgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtaggcaagaaggaagggggagcaatgtacgccgatgatacagcaggatgggacacaagaatcacactagaagacttaaaaaatgaagaaatggtaacaaaccacatgaaaggagaacacaagaaactagccgaggccatatttaaattaacgtaccaaaacaaggtggtgcgtgtgcaaagaccaacaccaagaggtacagtaatggatatcatatcgagaagagaccaaagaggcagtgggcaagtcggcacctatggcctcaataccttcactaatatggaagcccaattaattagacagatggagggagaaggaatcttcaaaagcattcagcacctgacagtcacagaagaaatcgctgtacagaactggttagcaagagtggggcgtgaaaggctatcaagaatggcaatcagtggggatgattgtgttgtaaaacctatagatgacagatttgcaagtgctttaacagctctaaatgacatgggaaaagttaggaaagatatacaacaatgggaaccttcaagaggatggaatgattggacacaagtgcctttctgttcacaccactttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 7138 - RNA, 9876 nt, synthetic construct
  misc_feature 1..9876: note = derived and/or modified CDS sequence (wt) from DENV-2__HQ332187__SS-prME
  source 1..9876: mol_type = other RNA
acagcaggcgtgatcattatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaactgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccctcaatgacaatgcgctgcataggaatatcaaatagagacttcgtggaaggggtttcaggagggagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagaatacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccattttaggtgacacagcctgggactttggatccctgggaggagtgttcacatctataggaaaggctctccaccaagttttcggagcaatctacggggctgcttttagtggggtctcatggaccatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcacgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgtgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccctggtcacagccggacatgggcagattgacaacttttcactaggagtcttgggaatggcactgttcctggaagaaatgctcaggacccgagtaggaacgaaacatgcaatactgctagttgcagtatcttttgtaacattgatcactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttggccttgggcatgatgatcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttatgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagttagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaaaaaaagattgaccatcatggacctccatccaggagcaggaaagacaaaaagataccttccagtcatagtcagagaagccataaaacgtggcttgagaacattaattctggctcccactagagtcgtggcagctgaaatggaggaagcccttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcttgtctcaggaaaaatggaaagaaagtgatacaactcagtaggaaaacttttgactctgagtatgttaagaccagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctattgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcctatgcgtgactcaagtattaatgatgaggactacatgggctttgtgtgaggctttaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatcttggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagttgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgcgaggctgttgaagatggtaggtttggggagctggttgacaaggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtaggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgatatgggaaaagttaggaaagatatacaacaatgggaaccttcaagaggatggaatgattggacacaagtgcctttctgttcacaccattttcatgagttagtcatgaaagatggccgcgtgctcgtagtcccatgcagaaaccaagatgaactgattggtagagcccgaatttcccagggagccgggtggtctttgaaagagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattaattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 7139 - RNA, 9876 nt, synthetic construct
  misc_feature 1..9876: note = derived and/or modified CDS sequence (wt) from DENV-2__HQ332188__SS-prME
  source 1..9876: mol_type = other RNA
acagcaggcgtgatcgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagacacaatcacgtacaagtgtcctctcctcagacaaaatgaaccagaggacatagattgttggtgcaactctacgtccacatgggtaacttacgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtggaaggggtttcaggaggaagctgggttgacatagtcttagaacatggaagttgtgtgacgacgatggcaaaaaacaaaccaacattggattttgaactgataaaaacagaagccaaacaacctgccactctgaggaagtactgtatagaagcaaagttgaccaacacaacgacagaatcgcgttgcccaacacaaggggaacccagcctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacttgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagagtacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccatcggccagatgttcgagacaacaatgagaggagcaaagagaatggccattttaggtgacacagcctgggattttggatccctgggaggagtgttcacatctataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggagtcgtgacactgtacctgggagctatggtgcaggctgatagtggctgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtgaagttgaccattatgacaggagacactaaaggagtcatgcaggcaggaaaacgatccttgcggccccagcccactgagctgaagtactcatggaaaacatggggaaaggcgaaaatgctctccacagagtctcacaatcagacctttcttattgatggccctgaaacaacagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaatagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacccctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagcgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaaatccaagtcctggcattggaacctggaaaaaatcccagagccgtccaaacaaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaaaaaaagattgaccatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagctatcaaagccgagcataccgggcgggagatcgtggacctaatgtgtcatgccacatttactatgaggctgctatcaccagtcagagtgccaaattacaacctgatcatcatggacgaagcccacttcacagacccagcaagcatagcagctagaggatacatctcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcttgtctcaggaaaaatggaaagaaagtgatacaactcagtaggaaaacttttgactctgagtatgttaagaccagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaagcaggtggaagggcgtataatcatgctctcagtgaactgccggaaaccctggagacactgcttctactgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagagaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaacctgagagcaacatcctagacatagatctacgccctgcatcagcatggacgctgtatgccgtggctacaacatttgtcacaccaatgttgagacatagcattgaaaattcctcagtgaatgtctctctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagttgatggaataacagtgattgacctagaaccaataccctatgatccaaaatttgaaaagcagttaggacaagtaatgctcctaatcctatgcgtgactcaagtattaatgatgaggactacatgggctttgtgtgaggctctaaccttggcgaccgggcctatctccacactgtgggaaggaaatccagggaggttttggaacactaccattgcagtgtcaatggctaacatctttagagggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatctcggttgcggcagagggggctggtcatactattgcgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaattccacgcatgaaatgtactgggtatctaatgccaccggaaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgagaatcacggcagagtggctttggaaagaactaggaaagaaaaagacccctagaatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatatttaaattaacgtaccaaaacaaggtggtgcgtgtgcaaagaccaacaccaagaggcacagtaatggatatcatatcgagaagagaccaaagaggcagtgggcaagtcggcacctatggcctcaataccttcaccaatatggaagcccaattaattagacagatggagggagaaggaatcttcaaaagcattcagcacctgacagtcacagaagaaatcgctgtacagaactggttagcaagagtggggcgtgaaaggctatcaagaatggcaatcagtggggatgattgtgttgtaaaacctatagatgacagatttgcaagtgctttaacagctctaaatgacatgggaaaagttaggaaagatatacaacaatgggaaccctcaagaggatggaatgattggacacaagtgcctttctgttcacaccactttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgctatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacctgggaaaaagagaagaccaatggtgcggctcattaattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 7140 - RNA, 9876 nt, synthetic construct
  misc_feature 1..9876: note = derived and/or modified CDS sequence (wt) from DENV-2__HQ332189__SS-prME
  source 1..9876: mol_type = other RNA
acagcaggcgtgatcgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaaactggatcttgagacatccaggctttaccataatggcagcaatcttggcatacaccataggaacgacacatttccaaagggccttgattttcatcttactgacagctgtcgctccttcaatgacaatgcgctgcataggaatatcaaatagagacttcgtggaaggggtttcaggagggagttgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagagtacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccatttggagacagctacgtcatcataggagtagagccgggacaattgaaactcaattggtttaagaagggaagttccatcggccaaatgttcgagacaacaatgagaggagcaaagagaatggccattttaggtgacacagcctgggattttggatccctgggaggagtgttcacatctataggaaaggctctccaccaagttttcggagcaatctacggggctgcttttagtggggtctcatggactatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagcgagatgataattccaaaaaattttgccgggccagtgtcacaacacaactacagaccaggttaccatacacaaacagcaggaccttggcacctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcaccgccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcctgagaaaactgacctccaaggaattaatgatggccaccataggaatcacactcctttcccaaagtaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttatgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagttagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaaaaaaagattgaccatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcttgtctcaggaaaaatggaaagaaagtgatacaactcagtaggaaaacttttgactctgagtatgttaagactagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctattgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcctatgcgtgactcaagtattaatgatgaggactacatgggctttgtgtgaggctttaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatcttggttgcggcagagggggctggtcatactattgtgggggactaaagaatgtaagagaagtcaaaggtctaacaaaaggaggaccaggacacgaagaacccatccctatgtcaacatatgggtggaatttagtgcgtctgcaaagcggagttgacgttttcttcaccccgccagaaaagtgtgatacattgttgtgtgacataggggagtcgtcaccaagtcccacgatagaagcaggacgaacactcagagtcctcaacttagtggaagattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgagacatcatggcactatgatcaagaccacacatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaattagccgaggccatattcaaattaacgtaccaaaacaaggtggtgcgtgtgcaaagaccaacgccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaatgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcctacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacctgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 7141 - RNA, 9876 nt, synthetic construct
  misc_feature 1..9876: note = derived and/or modified CDS sequence (wt) from DENV-2__JN368476__SS-prME
  source 1..9876: mol_type = other RNA
tctgcaggcatgatcattatgctgattccaacagtgatggcgttccatctaaccacacgtaacggagaaccacacatgatcgtcggtatacaggagaaagggaaaagtcttctgttcaaaacagaggatggtgtgaacatgtgcaccctcatggctatggaccttggtgaattgtgtgaagacacaatcacatacaagtgtcctctgctcaggcagaatgagccagaggacatagactgttggtgcaactccacgtccacgtgggtaacctatgggacttgtactaccacgggagaacatagaagagaaaaaagatcagtggcactcgttccacatgtgggaatgggactggagacgcgaaccgaaacatggatgtcgtcagaaggggcttggaaacatgcccagagaattgaaacttggatcctgagacatccaggcttcaccataatggcagcaatcttggcatacaccatagggacgacacatttccagagagccctgattttcattctattgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaatacaacaacagaatcccgttgcccaacacaaggggaacccagcctaaaagaagagcaggataagaggttcgtctgcaaacactccatggtagacaggggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacagggaaacacggcaaggaaatcaaagtaacaccacagagttccatcacagaagctgaattgacaggttatggcaccgtcacgatggaatgctctccgagaacaggcctcgacttcaatgagatggtgttgctgcagatggaaagtaaagcttggctggtgcataggcaatggttcctagacctgccattaccgtggctgcccggagcggacaaacaagggtcaaattggatacagaaagaaacattggtcactttcaaaaatccccatgcaaagaaacaggatgttgttgttttaggatctcaagaaggggccatgcatacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatacgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggagcaaagagaatggccattttgggtgacacagcctgggactttggctccctaggaggagtgtttacatctataggaaaagctctccaccaagtctttggagcaatctatggagctgccttcagtggggtttcatggactatgaaaatcctcataggagtcattattacatggataggaatgaactcacgcagcacttcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccccgagacggcagaatgccctaacacaaatagagcttggaactcgttggaggttgaagactacggctttggagtgttcaccaccaatatatggctaaaattgaaagagaaacaggatgcattctgcgactcaaaactcatgtcagcagccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactataggccaggctaccacacacaaacagcaggaccatggcatctaggcaagcttgagatggactttgatttctgcgatggaaccacagtgatagtgaccgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaattctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcaccaccatgacggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccattcttgaattgactgatgcgttagccttaggcatgatggtcctcaaaatagtaagagacatggaaaagtatcaattagcagtgactattatggctatcttgtgcgtcccaaacgcagtgatattacagaatgcatggaaagtgagttgcacaatactggcagtggtgtccgtttccccactgcttttgacatcttcacagcaaaaaacggattggataccattagcattgacaattaagggcctcaatccaacagccatctttctaacaaccctctcaagaaccaacaagaaaaggagctggccactaaatgaggccatcatggcagtcggaatggtgagcattctagccagttccctcctgaaaaatgacattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcatcagaacaggattgctggtgatctcaggactttttcctgtatcaataccaatcacggcagcagcatggtacctgtgggaagtgaagaaacaacgggccggagtattgtgggacgttccctcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgttcaaacaaaacctggtcttttcaaaaccaacaccggaacaataggtgccgtatctctggacttttcccctggaacgtcaggatctccaatcattgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagctataaaacggggtttgagaacattaatcttggcccccactagagttgtggcagctgaaatggaggaagctctcagaggacttccgataagataccaaaccccagctatcagagctgagcacactgggcgggaaattgtggatttaatgtgtcatgccacatttaccatgaggctgctatcaccagttagagtgccaaactacaacttgattatcatggacgaagcccatttcacagacccagcaagtatagcagctagaggatacatctcgacacgagtggagatgggtgaggcagctgggattttcatgacagccactcccccgggaagtagagatccatttcctcagagcaatgcaccaatcatagatgaagaaagagaaatccctgagcgttcatggaatactggacatgagtgggttacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgactgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaacccaaaaaatgaaaatgaccagtacatatacatgggagaacctctggaaaatgatgaagactgtgcacactggaaagaagccaaaatgctcctagacaacattaacacaccagaaggaatcattcccagtatgtttgaaccagagcgtgaaaaagtggatgccattgatggcgaataccgcttgagaggagaagcaaggaaaacctttgtggacttaatgaggagaggagacctaccagtctggttggcttacaaagtggcagctgaaggcatcaactatgcagacagaaggtggtgttttgatggaattaagaacaaccaaatcctggaagaaaatgtggaagttgaaatctggacaaaagaaggagaaaggaagaaattgaaacctagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgctcttactgacacttctggctacagtcacaggagggatctttttattcttgatgagcggaaggggcatagggaagatgaccctgggaatgtgctgcataatcacggctagcgtccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggattaggaagcattgcaacccagcaacccgagagcaacatcctggacatagatctacgtcccgcatcagcctggacgctgtatgccgtggctacaacatttgttacaccaatgctgaggcatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctcttctcttattggtagcgcattatgccatcatagggccaggacttcaagcaaaagcaaccagagaagcccagaaaagagcagcggcgggcatcatgaaaaatccaactgtcgatggaataacagtgattgatctagatccaataccttatgatccaaagtttgaaaagcagttgggacaggtaatgctactaatcctctgcgtgactcaagtattgatgatgaggactacatgggctctgtgtgaggccttgaccttagctacagggcccatctccacactgtgggaaggaaatccaggaaggttctggaacactaccattgcggtgtcaatggctaacatctttagagggagttacttggctggagctggacttctcttttccattatgaagaacacaactaacacaagaaggggaactggcaacataggagagacgcttggagagaaatggaaaagccgattgaatgcactgggaaaaagtgaattccagacctacaagaaaagtggaatccaagaagtggatagaaccttagcaaaagaaggcatcaaaagaggagaaacggaccatcatgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatacggaggagccttagtgagaaatccactctcacggaactccacacatgagatgtactgggtatccaacgcttctgggaacatagtgtcatcagtgaacatgatttcaaggatgttgatcaatagattcacaatgagacacaagaaagctacttacgagccggatgttgacctcggaagcggaacccgtaacattggaattgaaagtgaaataccaaacttagacataattgggaaaagaatagaaaaaataaaggaagagcatgaaacatcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagagaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttatattctaagagacgtgagcaagaaagagggaggagccatgtacgccgacgacacagcaggatgggacacaagaatcacactagaagacctaaaaaatgaagaaatggtaacaaaccacatggaaggagaacataagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagctgccgtgcaaaactggttggctagagtggggcgcgaaaggttgtcaagaatggccatcagtggagatgattgtgttgtgaaacctttagatgacaggttcgcaaacgctttgacagctctgaatgacatgggaaagattagaaaagacatacaacaatgggaaccttcaaaaggatggaacgattggacacaagtgcccttctgttcacaccatttccatgagctaatcatgaaggatggtcgtgtacttgttgttccatgtagaaatcaagatgaactgattggcagagcccgaatctcccaaggagcagggtggtctttgcgggagacggcctgtttggggaagtcttacgcccaaatgtggagcttaatgtatttccacaggcgtgacctcaggctggcggcaaatgccatttgctcggcagtgccatcacactgggttccaacaagtcgaacaacctggtccatacacgctaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggctaacaagcagggccacatgggcaaagaacatccaagcagcaataaatcaagttagatctcttataggcaatgaggaatacacagattacatgccatccatgaaaagattcagaagagaagaggaagaagcaggagtcctgtggtaa

SEQ ID NO: 7142 - RNA, 9876 nt, synthetic construct
  misc_feature 1..9876: note = derived and/or modified CDS sequence (wt) from DENV-2__JF260983__SS-prME
  source 1..9876: mol_type = other RNA
acagcgggcttccttatcatggtcattccaacagtgatggctttccatttgaccacacgcaacggggagccacacatgattgtcagcaagaatgagaaaggaaagggcctcctttttaaaacagagaatggaataaacatgtgcacccttatggccatggacttaggcgagttgtgtgaggacaccgtcacatacaagtgccccttcctcaagcaaaacgagccggaggatatagactgctggtgcaattccacatcaacctgggtgacgtacgggacgtgcagctcgacaggagagcataggagggagaaaaggtcagtcgcacttgtcccacatgtaggaatggggctggaaacgagaactgaaacatggatgtcatcagaaggagcatggaaacaagcccagcggattgagacatggattctgaggcacccaggcttcactcttatggcagctgtcttggcgtacacaatagggacaacacatttccaaagagccctaatctttatccttttaacagctgttgctccctcgatgacaatgcgatgtataggcatatcaaatcgagacttcgtggagggagtttcaggaggaagctgggttgatatcgtcttagaacacggaagctgcgtcacaacaatggccaagaacaaaccaacattagactttgaactaataaaaacagaggccaagcaaccagcaacattgagaaaattctgcatagaagccaaattgaccaacacaacaacagaatctcgctgcccaacccaaggtgaacccagcctagtagaggagcaggacaaaagattcgtctgcaggcattcaatggtggatagaggctggggtaatggatgtggtctgtttgggaaaggaggtattgtgacctgtgcgatgttcacatgcttgaagaaaatggagggaaaagttgtgcagccagaaaacctagagtacaccatagtcataacaccccattcaggagaggaacatgctgtggggaatgatacagggaagcacggtaaggaggttaagataacacctcaaagctctatttctgaaactgaactgacagattatggcacgatcacgatggaatgctccccacgaacaggtctcgattttaatgagatggtcctgctgcagatggagagcaaagcttggctagtccatagacagtggtttctggacttacctctaccatggcttcctggagcagacacacaagggtccaattggatccagaaagagatgctagtaacattcaaaaatccccatgcgaaaagacaggacgttgtcgtcttaggatcacaagagggcgctatgcacacagcactcacaggagcaacagaaattcaaatgtcattaggaaatatactattcatggggcatttgaagtgtagactgaggatggacaagctgcaactcaaagggatgtcatactccatgtgtacaggaaagtttaaagttgtcaaagagatagcggaaacacaacatggaacgatagtcatcagagtgcagtatgaaggagatgactcaccatgtaagattccctttgagatcatggacttggaaaagaaacatgttttagggcgactgatcacggtcaacccaatagtgacagagaaagacagtccaatcaacatagaagcagaacctccattcggtgatagctacattgtcataggagtggagccaggacagctgaaattaaactggtttaaaaagggaagctctataggacaaatgtttgaaacaacaatgagaggagctaaaagaatggccatcttgggagacacagcttgggattttggatccatagggggagtgttcacatcagtaggaaaagcactacatcaagtttttggcgcaatctatggcgccgcctttagcggggtttcatggaccatgaagatcctcataggggtggttataacatggataggaatgaactcccgcagcacttccttgtcagtgaccctggtgttagtaggaatcgtgacactatacctgggagtgatggtgcaagcggacagtggttgcgttgtaagctggaagaacaaagaactgaaatgtggaagtggaatctttgtgactgacaatgtgcacacttggacggaacaatacaaatttcaaccagactccccttcaaagttggcttctgcaattcaaaaagcccatgaggaaggaatctgtggaatccgttcagttacaaggttggaaaatctaatgtggaagcagataacaccagaattgaaccacatcctatctgaaaatgaagtcaaactgaccatcatgacaggagagattaaggggattatgcaagcagggagaagatctttgaaaccccaacccactgagctgagatactcatggaaaacttggggaaaagcgaaggtactatcaacagaacttcaaaatcagactttcctcatagacggtcctgaaacaactgaatgccctaacagcaatagagcctggaactctttggaagttgaggattatggctttgggatttttaccaccaatatatggctaaagttgagagagaaacaagacatgatttgtgattcaaagttgatgtcagcagctgtcaaggacgacagagcagttcatgctgatatgggctattggatagagagcagactgaatgacacatggaagatggaaaaagcatcatttattgaggttaaaagctgctactggccaagatcacacaccctttggagcaatggagtgctggagagtgaaatgataattccaaagaatctggctggaccagtgtcgcagcacaactacagaccaggctattacacacaaacagccggaccatggcatttgggcaaactcgagatggatttcgagttttgtgaaggaaccacggtagtggtgaccgaggattgcggaaacagaggaccatccctgagaacaaccactgcctcaggaaaactcataactgagtggtgctgcagatcatgcacattaccaccactaagatacagaggagaggatggatgctggtacggaatggaaattagaccactgaaagaaagagaagagaacctggtgaactcattggttacagccggacatggccaaattgacaatttctcactagggattttgggaatggcattgctcttggaagagatgcttagaaccagagtaggaacaaagcacgccttgctgctagtggcgatctccttcgtgacactgattacagggaacatgtccttcaaggatctaggaagagtgataattatggtgggagcagccatgacggacgagatgggtatgggcgtgacatacttggcattactagctgctttcagagtcagacccacctttgcagtggggttgcttttaagaaaactcacttcaaaggaattgttgatggcaaccatcggagtcgttctcctctctcagagcaacataccaggaacagttttggaattgaccgatgcaatagcattgggaataatggttcttaaaataatgaggagcatggaaaaataccagctagcagtgaccgtcatggctatgctatgtattccaaatgtcatgatactccagcatgcatggaaagtaggttgcaccatattggcagcagtctctgtatcaccactcctcctgacttcctcacaacaaaaaacggactggataccgttagccctcacaataaaaggtctcaatccaactgctattttcttaacaactctgtctagacccagtaaaataagaagttggcctcttaatgaagccatcatggcagttggaatggtgagcatattagctagttccctcttgaaaaatgacattccaatgacgggaccactggtggcaggaggacttctcacagtgtgctatgtgcttactggcagatcggcagacttggagctagaaaaagcggcagaggtgaaatgggaagatcaagctgagatatccgggagtagcccaatcctatcaatcactatatcagaagatggtagtatgtcaataaagaatgaggaagaagagcagactctaaccatactgataaggacaggactgttagtaatatcaggactattcccagtatcaatcccaatcacagccgcggcctggtacctatgggagacaaaaaagcagagggccggagtgctgtgggacgttccttcacctccaccaatgggaaaagctgagctagaagatggcgcttacaggatcaaacagagagggattttcggatactctcaaattggggccggagtgtataaagaaggtacatttcacacgatgtggcacgtcacacgtggagccgtcctagtgcacaaagggaaaagacttgagccatcatgggcagacgtgaagaaagacttgatatcatatggaggaggctggaaactggaaggagagtggaaagatggcgaagaggttcaggttttagcgctggaacccggaaaaaacccgagagcagtgcaaacaaaacccggcctcttcaaaaccaacacaggaacaataggagccgtttccttagacttttccccaggaacatcaggatccccaatcattgacaggaaaggaaaagtcgtgggtctctacggaaatggtgtcgtgacaagaagcggaacctatgtgagctccatagcccaaacagagaaaagtgtagaggacaatccagagattgaagatgatatatttcggaagaaaaggttaaccatcatggacttacatccaggagcggggaaaacaaaacgatatctcccagccatagttagagaagcaataagaagaggcctgagaacactgattctagcccccactagagtagtggctgcagaaatggaggaagccctacgggggctcccaatccgttaccagactccggccattaaggcagagcacactgggcgcgaaatcgtagacctaatgtgtcatgccacattcactatgaggttattgtcaccaattagggtaccaaactacaacctaatcataatggatgaagcccatttcacagacccagctagcatagcagcccgaggatacatctccacccgtgtagaaatgggagaagctgctggaatatttatgacagccactcctccaggcagtagggacccttttccacagagcaacgccccaataatggacgaggaaagagagatccctgaacgctcatggaattccggacatgaatggataacaaacttcaaaggtaaaacagtatggtttgtcccaagcataagagctggaaacgacatagcagcctgcttaagaaaaaatgggaaaagagtgattcagctaagtaggaaaacctttgacacagaatacaccaaaacaagaacaaacgactgggacttcgtagtcacgactgacatctcggaaatgggggcaaacttcaaagctgaaagagtgatagatccaaggagatgcatgaagccagttatattgacagatggtgaagagcgcgtggttctggcaggacctatgccagttactcactcaagtgcagcacagagaagagggagaataggaaggaatccaaaaaatgagaacgaccaatatatttacatgggagaacctttagagaatgatgaagactgtgctcactggaaggaggcaaagatgctccttgataacatcaacacacctgaaggtatcatccccagcatgttcgagccagaacgtgagaaagttgatgccatagacggtgaataccggttaaggggggaagcaagaaaaacctttgtagacctgatgaaaagaggagacctaccagtttggctggcttacaaggtagcttcggaaggcataaactatgcagacaggaagtggtgctttgatggaatcagaaacaatcagatcctagaggagaacattgaagtggaagtttggacgaaagaaggtgagaggaaaaaactaaaacccagatggctggacgcaagaacttattcagatccgctagcactcaaagagttcaaggaatttgcggccggaaggaagtctctaaccttgagtttgatcacagaaatgggccggctcccaaccttcatgacccaaaagacaagagatgccctggacaacttggctgtgttgcactccgcagaaatgggtggaagagcctataaccatgctctcagtgaactgccagaaactctagaaacattactcttgctaggtcttctggccacagtcacagggggaatctttttgttcttgatgagtggaagaggtgtagggaaaatgactctcggaatgtgttgcataatcacggccagcggccttctgtggtatgcacagatacagccccattggattgcagcttcaataatattggagttctttctcatagtactgctaatccctgaaccagaaaagcaaagaacaccacaggacaaccagttgacctatgtggtcatagccatcttgacactagtggcagccaccatggcaaacgaaatgggttttctagaaaagacaaagaaagaccttgggttgggaggcttcacaatgcaacaaccagaaataaacattttggacatagacctccgacctgcatcagcgtggacgctatatgcagtggccactacgtttgtcacgccaatgctgaggcacagcatagaaaactcctcagtgaatgtgtcactaacagctatagcaaatcaggccacggtgcttatgggcttgggaaaaggttggccactatcaaaaatggacataggagttcctcttcttgccattgggtgctactcgcaggtgaatcccataaccctcacagcagcactactgctattggtggcacactacgccatcataggtcctggactccaagcaaaggctaccagagaggcgcagaaaagagcagcagccggcatcatgaagaatccaacagtagatgggatcacagtgattgacctagaaccaataccctatgatccgaagtttgagaagcagctagggcaagtgatgcttttagtcctttgtgtgacacaggtgttgatgatgagaaccacgtgggctctatgcgaagccctaaccctagcaacagggcccatatcaacactgtgggaaggaaatccaggaaaattttggaacacaacaatagcagtttctatggctaatatcttcagagggagttatttggctggagctggactccttttctccatcatgaggaacacaaccagcgcacgaagaggaaccggcactataggtgaaactttaggagaaaaatggaagagtcggctaaatgcactgggaagaagtgaattccaaatatacaagaaaagtgggattcaggaagtagacagaaccctggcgaaggaaggcataaaaagaggagaaacagaccaccatgccgtttcacggggctctgcaaagctgagatggtttgttgaaagaaacatggttgccccggagggaaaggtagtagaccttggttgtggcagaggaggatggtcatattactgtggtggactaaaaaatgtgagagaagtcaaaggcctgactaaaggaggaccaggacatgaggagcctatacctatgtcaacatacgggtggaatctagtgcgactgcagagtggagtggatgtattctttactccaccagagagatgcgacacactgctatgcgacataggagaatcatcaccaaaccccacagtggaggccggacgaacactgagagttctcaatctagtagaaaattggttgggaagcaacacacagttttgcataaaagtccttaacccttacatgccatcagtcatagagagaatggaaacattacagagaaagtttggaggcgctctagtccgcaatccactttcaaggaattccacgcacgagatgtactgggtgtccaacgcttctggaaacattgtatcttctgtgaacatgatttcaaggatgttgataaatagattcacaatgaggcacaagaaagccacctacgagcctgacgttgatcttggaagtggaacacgcaacatcggaattgagtgtgaaacgccaaacatggacataattggaaaacggattgagaaaataaaacaagaacatgaagcgtcatggcactatgaccaagatcatccatacaaaacatgggcataccacggcagttatgagacgaaacaaacaggatcagcatcatcaatggtaaacggagtggttaggctattgacaaaaccctgggatgtcattcccatggtgacgcaaatggcaatgacagacacaaccccctttggacagcagcgtgttttcaaggaaaaagtagatacaagaacccaggaaccaaaagagggcacgaaaaaattgatgagaatcacagcagagtggctttggggtgagttaggaaggagaaagaagcctagaatctgcacaagagcagagttctgtaataaagtgagaagcaacgcagctctgggggccgtgttcactgatgagaacaagtggaagtcagcacgcgaagcggtcgaagatgaaagattttgggagctggtggaaaaagagagaaaccttcacctcgacggaaagtgtgaaacatgtgtgtacaacatgatgggaaaaagagagaagaaacttggagaatttggcaaagcaaaaggcagcagagccatatggtatatgtggctaggtgcccgctttctagagtttgaggccctaggttttttgaacgaagaccattggttctctagagaaaattctctaagtggagtggaaggagaaggactgcacaagctgggctacatcctaagagacatcagcaggaaagcaggaggagcaatgtatgcagatgacactgctggttgggacacaaggatcacatctgaggatctgaagaatgaagaaatgataacagaccaaatggaagggagacataagaagctggcagaggccatattcagactaacatatcagaataaggtagttcgcgtccaaagaccaaccccaagaggcacggtgatggacatcatttcaaggagagaccaaagaggcagtgggcaggtggggacgtacggtctcaacaccttcaccaatatggaagcacaactgataaggcagatggaaggggaaggactctttaagagcatactgcacttaacaccccaagaggaaactgctgtccacgcttggctagttagagagggacgcgaacgcctcgcaagaatggcaatcagtggagatgactgcgtcgtgaaaccactagatgacagattcgccagagctctaacagcattgaatgacatgggaaaagtgaggaaagacatacaacagtgggaaccctcaaaaggatggagtgattggacccaagtgcccttttgctctcaccactttcatgaactaataatgaaagatggtcgcaagcttgtagtcccatgcagaaaccaggatgaactgataggcagagcgcgcatctcccagggggcaggatggtccttgagagagacagcctgtttggggaagtcatatgcccagatgtggagcctgatgtacttccacaggcgtgatctcaggttggctgcaaatgccatatgttcagcagttccatcacattgggttccaactagcaggacgacttggtccatacatgctagtcatgaatggatgacgacggaagacatgctagcagtctggaacagggtgtggatccaggacaacccatggatggaagacaagacccccgtggaatcatgggaagacataccatatctagggaaaagggaggatcagtggtgtggttccctgattggattaacaagcagggccacttgggcaaagaacattcaaacagccataaaccaggtcagagctctcattggtgaggaggaatacatggactacatgccctcaatgaaaaggttcagaagtgaagaggaggaatcaggagtcctgtggtaa

SEQ ID NO: 7143 - RNA, 9876 nt, synthetic construct
  misc_feature 1..9876: note = derived and/or modified CDS sequence (wt) from DENV-2__AF119661__SS-prME
  source 1..9876: mol_type = other RNA
acagtaggcgtgattattatgttgattccaacagcgatggcgttccatttaaccacacgtaatggagaaccacacatgatcgttggtagacaagagaaagggaaaagtcttctgttcaaaacagaggatggtgtgaacatgtgtaccctcatggccatagatcttggtgaattgtgtgaagatacaatcacgtacaagtgccccctcctcaggcagaatgaaccagaagacatagattgttggtgcaactccacgtccacatgggtaacttatgggacgtgtaccaccacaggagaacacagaagagaaaaaagatcagtggcactcgttccacatgtgggtatgggactggagacacgaactgaaacatggatgtcgtcagaaggggcctggaaacacgctcagagaattgaaacctggatcttgagacatccaggctttatcataatggcagcaatcctggcatacaccataggaacgacacatttccaaagggccctgattttcatcttactgacagctgtcgctccttcaatgacaatgcgttgcataggagtatcaaatagagactttgtagaaggggtttcaggaggaagctgggttgacatagtcttagaacatggaagttgtgtgacgacgatggcaaaaaacaaaccaacattggattttgaactgataaaaacagaagccaaacaacctgtcactctaaggaagtactgtataaaagcaaagctgaccaatacaacaacagaatctcgttgcccaacacaaggggaacccagtctaaatgaagagcaggacaaaaggttcgtctgcaaacactccatggtagacaggggatggggaaatggatgtggattatttggaaagggaggcattgtgacctgtgctacgtttacatgcaaaaagaacatggaaggaaaaatcgtgcaaccagaaaatttggaatacaccatcgtgataacacctcactcaggagaagagcacgctgtaggtaatgacacaggaaaacatggtaaggaaatcaaaataacaccacagagttccatcacagaagcagaactgacaggctatggcaccgtcacgatggagtgctctccgagaacgggccttgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactattcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaacccgatcgtaacagaaaaagatagcccagtcaacatagaagcagaacctccattcggagacagctacatcatcataggagtagagccgggacaattgaaactcaactgggttaagaaaggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcctttagtggggtctcatggactatgaaaatcctcataggagtcatcatcacatggataggaatgaattcacgtagcacctcactgtctgtgtcactagtattggtgggagtcataacactgtacttgggagccatggtgcaggctgatagtggttgcgttgtgagctggaaaaacaaagaactgaaatgtggcagcgggattttcatcacagataacgtgcacacatggacagaacaatacaagttccaaccagaatccccttcaaaactagcttcagctatccaaaaagctcatgaagaaggcatttgtggaatccgctcagtaacaagactggagaatctgatgtggaaacaaataacaccagaattgaatcacattctatcagaaaatgaggtgaagttgaccattatgacaggagacattaaaggaatcatgcaggcaggaaaacgatctctgcggccccagcccactgagctgaagtattcatggaaaacatggggaaaggcgaaaatgctctccacagaatctcacaaccagacctttctcattgatggccctgaaacagcagaatgccccaacacaaacagagcttggaactcgctggaagttgaagactatggttttggagttttcaccaccaatatatggctaaaattgagagaaaaacaggatgtgttttgtgactcaaaactcatgtcagcagccataaaagacaacagagccgtccatgccgatatgggttattggatagaaagtgcactcaatgacacatggaagatggagaaggcctctttcattgaagttaaaagctgccactggccaaagtcacacaccctctggagtaatggagtattagaaagtgagatgataattccaaaaagttttgctgggccagtgtcacaacacaactacagaccaggctattacacgcagacagcaggaccttggcatctaggtaagcttgagatggactttgatttctgcgaaggaactacagtggtggtgactgaggactgcggaaatagaggaccctctttaagaacgaccactgcctctggaaaactcataacagaatggtgctgccgatcctgcacattaccaccgctaagatacagaggtgaggatggatgctggtatgggatggaaatcagaccattgaaagagaaagaagagagtttggtcgactccttggtcacagccggacatgggcagattgacaacttttcactaggagtcttgggaatggcactattcctggaagaaatgctcaggacacgagtaggaacgaaacatgcaatactgctagttgcagtttcttttgtgacattgattactgggaacatgtcccttagagacctgggaagagtgatggttatggtgggcgctaccatgacggatgacataggtatgggagtgacttatcttgccctactagcagctttcaaagttagaccaacttttgcagctggactactactgagaaagttgacctccaaggaattaatgatggctaccataggaatcgcactcctttctcaaagcaccataccagagaccattcttgaactaactgatgcgttagccttgggcatgatggtccttaaaatagtgagaaatatggaaaagtaccaattggcagtgactatcatggccatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagctatttttctaacaactcttgcgagaaccagcaagaaaaggagctggccgctaaatgaggctatcatggcagtcgggatggtgagcattttagccagttctctcttaaagaatgacattcccatgacaggtccattagtggctggagggctccttactgtgtgttacgtgctcactggacgatcggccgatttggaactggagagagccaccgatgtcaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggactctttccagtgtcaataccaattacggcagcagcatggtacctgtgggaagtgaagaaacaacgggctggagtattgtgggacgtcccttcacccccacccgtggaaaaggccgaactggaagatggagcctatagaatcaagcaaaaagggattcttggatattcccagattggaaccggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaagtccaagtcctggcattggaacctggaaaaaatccaagagctgtccaaacgaaacctggacttttcaaaaccaacaccggaaccataggcgccgtatctctggacttttcccctggaacgtcaggatctccaattgtcgacagaaaaggaaaagttgtgggtctttatggcaatggtgttgtcacaaggagtggagcatacgtgagtgctatagcccagaccgaaaaaagcattgaagacaatccagagatcgaagatgacattttccgaaagaaaagattgaccatcatggacctccatccaggagcgggaaagacaaaaagataccttccagccatagttagagaggccataaaacgtggcttgagaacattaatcctggcccccactagagtcgtggcagctgaaatggaggaagctcttagaggacttccaataagataccaaaccccagccatcagagccgagcacaccgggcgggagattgtggacctaatgtgtcatgccacatttactatgaggctgctatcaccagtcagagtgccaaattacaacctgatcatcatggatgaagctcacttcacagacccagcaaatatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaactctggacatgaatgggtcacggattttaaagggaagactgtttggtttgttccaagtataaaagcgggaaatgacatagcagcttgtctcagaaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccccagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgcttgagaggagaagcaaggaaaacctttgtggacctaatgagaagaggggacttaccagtctggttggcctacagagtggcagctgaaggcatcaactacgcagacagaaggtggtgttttgatggagttaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaagtccttgaccctgaacctaatcacagaaatgggtaggcttccaactttcatgactcagaaggcaagagacgcactggataacctagctgtgctgcatacggctgaggcaggtggaagggcgtacaatcatgctctcagtgaactgccggagaccctggagacactgcttttactgacactcctggctacagtcacgggaggaattttcttattcttaatgagcggaaaaggtgtagggaagatgaccctgggaatgtgctgcataatcacggctagtatcctcctatggtatgcacagatacaaccacactggatagcagcttcaataatattggagttttttctcatggttttgctcattccagaaccagaaaaacagagaacaccccaagataaccaattgacctacgttgtcatagccatcctcacagtggtggccgcaaccatggcaaacgagatgggtttcctggaaaaaaccaagaaagatctcggattgggaagcattgcaacccaagaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttcccctccttgccattggatgctactcacaagtcaaccccataactctcacagcagctcttcttttgctggtagcacattatgccattatagggccaggacttcaagcgaaagcaaccagagaagctcagaaaagagcagcagcaggcatcatgaaaaacccaacagtcgatggaataacagtgattgacctagatccaataccctatgatccaaaatttgaaaaacagttaggacaagtaatgctcctaattctctgcgtgactcaagtattaatgatgaggactacatgggctctgtgtgaggctctaaccttagcgaccgggcccatctccacattgtgggagggtaatccagggaggttttggaacactaccattgcagtgtcaatggctaacatctttagagggagctacttggccggagctggacttctctttttcatcatgaagaacacaacaaatacaagaagaggaactggcaacataggagagacgcttggagagaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtacgtctgcagagtggagttgatgttttcttcactccgccagaaaagtgtgatacattgttgtgtgacataggggagtcgtcaccaaatcccacgatagaagcaggacgaacactcagagtcctcagcttggtggaaaattggttgaacaatgacacccaattttgcataaaggttctcaacccatatatgccctcagttatagaaaaaatggaaacactgcaaaggaaatatggaggagccttagtgaggaatccactctcacgaaactccacacatgagatgtactgggtatccaatgctactgggaacatagtgtcatcagtgaacatgatttcaaggatgctgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacatgggcttaccatggcagctatgaaacaaaacagactggatcagcatcatccatggtgaacggagtggtcagactgctgacaaaaccttgggacgtcgtccctatggtaacacagatggcaatgacagacacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagccttgggggccatattcactgatgagaacaaatggaagtcggcacgcgaggctgttgaagataataggttttgggagctggttgacaaggaaagaaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcttggagtttgaagccctaggattcttgaatgaagatcactggttctccagagagaactccctgagtggagtggaaggagaagggctgcacaagctaggctacattttaagagacgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatatttaaattaacgtaccaaaacaaggcggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagacatacaacaatgggaaccttcaagaggatggaacgattggacacaagtgcctttctgttcacaccattttcatgagttaatcatgaaagacggtcgcgtgctcgtagttccatgcagaaaccaagatgaactgattggcagggcccgaatttcccagggagctgggtggtctttgaaggagacggcctgtttggggaagtcctacgcccaaatgtggagcctgatgtacttccacagacgtgacctcaggctggcggcaaatgctatttgctcggcagtcccgtcacattgggttccaacaagtcgaacaacctggtctatacacgccaaacatgaatggatgacgacggaagacatgctgacagtctggaacagggtgtggatccaagaaaacccatggatggaagacaaaactccagtggagtcatgggaggaagtcccatacttgggaaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 7144 - RNA, 9876 nt, synthetic construct
  misc_feature 1..9876: note = derived and/or modified CDS sequence (wt) from DENV-2__EU056810__SS-prME
  source 1..9876: mol_type = other RNA
actgcaggcataattatcatgttgattccaacagtgatggcgttccatttgaccacacgcaacggagaaccacacatgatcgtcagtagacaagagaaagggaaaagtcttctgtttaaaacagaggatggtgtgaacatgtgtaccctcatggccatggatcttggtgaattgtgtgaagacacaatcacttataattgtcctcttcttaggcagaatgaaccagaagatatagactgttggtgcaactccacgtccacatgggtaacttatgggacatgcaccgccacaggagaacacagaagggaaaaaagatcagtggcactcgttccacatgtgggaatgggactggagacacgaactgaaacatggatgtcatcagaaggggcctggaaacacgcccagagaattgaaacttggatcttgagacatccaggctttaccataatggcagcaatcttggcatacaccataggaacgacatattttcaaagagtcctgattttcatcttgctgacagctgtcgctccttcaatgacaatgcgttgtataggaatatcaaatagagactttgtggaaggggtttcaggaggaagctgggttgacatagtcttagagcatggaagctgtgtgacgacgatggcaaaaaataaaccgacattggattttgaactgataaaaacagaagccaaacaacccgctactctaaggaagtattgtatagaggcaaagctgaccaacacaacaacagcatctcgctgcccaacacaaggggaacccagcctaaatgaagagcaggacaaaaggttcgtctgcaaacattccatggtagacagaggatggggaaatggatgcggattatttggaaagggaggcatcgtgacttgtgctatgttcacatgcaaaaagaacatggaaggaaaagtcgtgcaaccagaaaacttggaatacaccattgtgataacacctcactcaggggaagagaatgcagtcggaaatgacacaggaaaacacggcaaggaaatcaaaataacaccacagagttccatcacagaagcagaactgacaggctatggcactgtcacgatggagtgctctcctagaacgggcctcgacttcaatgagatggtgttgctgcaaatggaaaacaaagcttggctggtgcacagacaatggttcttagacctgccgttaccatggctgcccggagcggacacacaaggatcaaattggatacaaaaggagacattggtcactttcaaaaatcctcatgcgaagaaacaggatgttgttgtcttaggatcccaagaaggggctatgcatacagcacttacaggggccacggaaatccagatgtcatcaggaaacttactgttcacaggacacctcaagtgcaggctgagaatggacaaactacagctcaaaggaatgtcatattctatgtgtacaggaaagtttaaagttgtgaaggaaatagcagaaacacaacatggaacaatagttgtcagagtacaatatgaaggggacggttctccatgcaagattccctttgagataatggatttggaaaaaagacatgtcttaggtcgcttgattacagtcaacccaattgttacagaaaaagacagcccagtcaacatagaagcagaacctccattcggagacagctacatcattataggagtagaaccgggacaactgaagctcaactggttcaagaaaggaagttctatcggccaaatgtttgagacaacaatgagaggagcgaagagaatggccattttaggtgacacagcctgggatttcggatccctgggaggagtgttcacatctataggaaaggctctccaccaagtttttggagcaatttatggggctgccttcagtggggtctcatggactatgaaaatcctcataggagttgtcattacatggataggaatgaattcacgcagcacctcactgtctgtgtcactagtattagtgggagtcgtgacattgtatttgggagttatggtgcaggccgatagtggttgcgttgtgagttggaaaaacaaagaactgaaatgtggcagtgggatttttgtcacagacaacgtacacacatggacagaacaatacaaattccaaccagaatctccttcaaagctggcttcagctatccagaaagctcatgaagaaggcatctgtggaatccgctcagtaacaagactggagaatctgatgtggaaacaaataacaccagaactgaatcacattttatcagaaaatgaggtaaagttgactatcatgacaggagacattaaaggaatcatgcaggcaggaaaacgatccttgcggcctcagcccactgagctgaagtattcatggaaaacttggggcaaagcgaaaatgctctctacagagcttcataaccagacctttctcattgatggccccgaaacagcagaatgtcccaacacaaacagagcttggaactcactagaagttgaagactatggctttggagtattcaccaccaacatatggctaaaattgaaagaaaggcaggatgtattttgtgactcaaaactcatgtcagcggccataaaagacaacagagccgtccatgccgatatgggttattggatagaaagcgcactcaatgacacatggaagatagagaaagcctcttttatcgaagttaaaagctgccactggccgaagtcacatactctctggagtaatggagtgctagaaagcgagatgataattccaaagaattttgctggaccagtgtcacaacacaactacagaccaggctatcacacacaaacggcaggaccctggcatctaggtaagcttgaggtggactttaatttctgcgaagggactacagtggtggtgaccggggactgtgggaatagaggaccctctttaagaacaactaccgcctctggaaaactcataacagaatggtgctgccgatcttgcacattaccaccgctaagatacagaggtgaggatggatgttggtacgggatggaaatcagaccattgaaagagaaagaagagaacttggtcaactctttggtcacagccggacatggacagattgataacttctcactaggagtcttaggaatggcattgttcctggaagaaatgctcaggacccgagtaggaacaaaacatgcaatattactagttgcagtttcttttgtgacattgatcacagggaacatgtcctttcgagacctggggagagtgatggttatggtgggtgccactatgacggatgatataggcatgggcgtgacttatcttgccctactagcagccttcaaagttagaccaacttttgcagctggactactcttgagaaagctgacctccaaggaattgatgatgaccaccataggaatcgtactcctctctcagagcaccataccagagactgtacttgaactgactgatgcactggctctggggatgatggtcctcaaaatagtgagaaatatggaaaagtatcaattagcagtgactatcatggctatcttgtgcgtcccaaatgcagtgatattacaaaacgcatggaaagtgagttgcacaatactggcagtggtgtccgtctcaccactgctcttaacatcctcacagcagaaagcggattggataccattggcattgacgatcaaaggcctcaatccaacagccattttcttaacaaccctttcaagaactagcaagaaaaggagctggccactaaatgaggctatcatggcagtcgggatggtgagcattttagctagttctctcttaaagaatgacatccccatgacaggaccactagtggctggagggcttctcacagtgtgttacgtgctcactggaagatcggccgatttggaactggagagggccgctgacgtgagatgggaagatcaggcagagatatcaggaagcagtccaattctgtcaataacaatatcggaagatggtagcatgtcgataaaaaatgaagaggaagaacaaacactgaccatactcattagaacaggactgttggtgatatcaggactttttcccgtatcaataccaatcacggcagcagcatggtacctgtgggaagtgaagaaacaacgggctggagtattgtgggatgtcccttcacccccacccgtgggaaaggccgaactggaagatggagcttatagaatcaagcagaaagggattcttggatactcccagatcggagccggagtttacaaagaaggaacattccacacgatgtggcacgttacacgtggtgctgttctaatgcataaagggaagagaattgaaccatcatgggcggacgtcaagaaagacctaatatcgtatggaggaggctggaagctagaaggagaatggaaggaaggagaagaagtccaggtcttggcattagagcctggaaagaatccaagagccgtccaaacaaaacccggccttttcaaaactaacaccggaaccataggcgccgtgtctctggacttttctcctggaacgtcaggatctccaatcgtcgacaaaaaaggaaaagtcgtgggtctttatggcaatggtgtcgtcacaaggagtggaacatatgtgagtgctatagcccagactgaaaaaagcattgaagacaatccagagattgaagatgacatctttcgaaagaaaagattgaccattatggacctccacccaggagcgggaaagacgaagagataccttccagcaatagtcagagaggctataaaacgaggcttgagaacattaatcctggcccccactagagtcgtggcagctgaaatggaggaagctcttagaggacttccaataagataccaaaccccagccatcagagctgagcacactgggcgggagattgtggatctaatgtgccacgccacatttaccatgaggctgctatcaccagttagagtgccaaattacaacctgatcatcatggacgaagcccattttacagacccagcaagcatagcagctagaggatacatttcaactcgagtagagatgggtgaagcagctgggattttcatgacagccactcctccgggaagcagagacccatttcctcagagcaatgcaccaattatggatgaagaaagggaaatccctgaacgctcgtggaattctggacatgagtgggtcacggactttaaagggaagactgtttggtttgttccaagtatcaaagcaggaaatgatatagcagcttgcctgagaaaaaatggaaagaaagtgatacaactcagtagaaagacctttgattctgaatatatcaagactaggaccaatgattgggacttcgtggtcacgactgacatttcagaaatgggtgccaacttcaaggctgagagggttatagaccccagacgctgcatgaaaccagtcatactaacagacggcgaagagcgggtgatcctggcaggacccatgccagtgacccactctagtgcagcacaaagaagagggagaataggaagaaatccaaaaaatgaaaatgaccagtacatatacatgggggaacctctggaaaatgatgaagactgtgcacattggaaagaagctaagatgcttctagataacatcaacacgcctgaaggaatcattcccagcatgttcgaaccagagcgtgaaaaggtggatgccattgatggtgaataccgcttaagaggagaagcgaggaaaacctttgtggacctaatgagaagaggagacctaccagtctggctggcctacagagtggcagctgaaggtatcaactacgcagacagaaggtggtgttttgatggaatcaagaacaaccaaatcttagaagaaaatgtggaagtggaaatttggacaaaagaaggggaaaggaagaaattaaaacccagatggttggatgctaggatctattctgacccgctggcactcaaagaattcaaggaattcgcagctggaagaaagtccctgaccctgaatctaatcacagagatgggtaggcttccaactttcatgactcagaaagcaaggaacgcactggacaacttagcagtcctgcatacggctgaagcaggcggaagggcatacaatcatgctcttagtgaactgccggagaccctggagacattgcttttactgacacttttggctacagtcacgggcggaatctttctattcttgatgagcggaaaaggtatagggaaaatgaccctgggaatgtgctgcataatcacggccagtattctcctatggtacgcacaaatacaaccacactggatagcagcttcaataatactggagttttttctcatagtcttgcttattccagaaccagaaaagcagagaacaccccaagacaaccaattaacttacgttgttatagccatcctcacggtggtagctgcaaccatggcaaacgagatgggtttcctggaaaaaacgaagaaagatttcggattgggaagcattgcaacccagcaacccgagagcaacatcctggacatagatctacgtcctgcatcagcgtggactctgtatgccgtggccacaacattcatcacaccaatgttgagacatagcattgaaaattcttcagtgaatgtttccctaacagctattgccaaccaagccacagtgttaatgggtcttgggaaaggatggccattgtcaaaaatggacatcggagttccccttctcgccattgggtgctattcacaagtcaaccccataactctcacagcagcccttcttttattggtagcacattatgctatcatagggccaggactccaagcgaaagcaaccagagaagctcagaaaagagcagcagcgggcatcatgaaaaacccaactgtagatggaataacagtgattgacctagatccaataccctatgatccaaagtttgagaagcagttgggacaagtaatgctcctagtcctctgcgtgactcaagtattgatgatgaggactacatgggctttgtgtgaggctctaaccctagcgaccgggcccatctccacattgtgggaaggaaatccagggagattttggaatacaactattgcagtgtcaatggctaacatttttagagggagttacttggccggagctggactcctcttttctatcatgaagaatacagccaacacaagaaggggaactggcaacacaggagagacgcttggagagaaatggaaaaaccgattgaatgcattggggaagagtgaattccagatctataagaaaagtggaattcaggaagtggacagaaccttagcaaaagaaggcattaaaagaggagaaacggaccatcacgctgtgtcgcgaggctcagcaaaactgagatggttcgtcgagagaaacctggtcacaccagaggggaaagtagtggacctcggttgcggcagagggggttggtcatactattgtgggggactaaagaatgtaagagaagtcaaaggcctaacaaaaggaggaccaggacacgaagaacccattcccatgtcaacatatgggtggaatctggtgcgtcttcagagtggagtcgatgttttttttactccgccagaaaagtgtgacacattgctgtgtgacataggggaatcgtcaccaaatcccacgattgaagcaggacgaacactcagagtcttaaacttagtggaaaattggctgaacaacaacacccaattttgtataaaggttctcaacccatacatgccctcagttatagaaaaaatggaagcgctacaaaggaaatacggaggagctttggtaaggaatccactctcacgaaattccacacatgagatgtactgggtttccaatgcttccgggaacatagtgtcatcagtgaacatgatttcaaggatgttgattaacagatttacaatgagacataagaaggccacatacgagccagatgttgacctcggaagcggaacccgcaacatcggaattgaaagtgagacaccaaacttagacataattggaaaaagaatagaaaaaataaaacaagagcatgaaacatcatggcactatgaccaagaccacccatacaaaacgtgggcctaccatggcagctacgaaacaaaacagaccggatcagcatcatccatggtgaacggagtagttagattgctgacaaaaccttgggacgtcatccctacggtgacacagatggcaatgacagacacgactccatttggacaacagcgcgttttcaaagagaaagtggacacgagaacccaagaaccgaaagaaggcacgaagaaactaatgaaaatcacggcagaatggctctggaaagaactgggaaagaaaaagacacctaggatgtgcaccagagaagaattcacaagaaaggtgagaagcaatgcagccctaggtgccatattcactgatgagaacaagtggaagtcggcacgtgaggctgttgaagacagtagattttgggaactggttgacaaggaaaggaatctccatcttgaaggaaagtgtgaaacatgtgtgtacaacatgatgggaaagagagagaagaagctaggggagtttggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaagctaggctacattttaagagatgtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacagtaatggatattatatcgagaagagaccaaagaggtagtggacaagttggcacctatggtctcaacactttcaccaatatggaagcccaactaatcaggcagatggagggagaaggagtcttcaaaagcatccagcacttgacagtcacagaagaaattacagtgaaaaactggctagcaagagtggggcgtgagaggttatcaagaatggccatcagtggagatgattgtgttgtgaaacctttagatgacaggtttgcaagcgctctaacagctctaaatgacatgggaaaggttaggaaagacatacaacaatgggaaccttcaagaggatggaacgactggacacaagtgcctttttgttcacaccacttccatgagttaatcatgaaagacggtcgtgtactcgtagttccatgtagaaaccaagatgaactgattggtagagcccgaatttcacagggagccgggtggtctttgcgggagacggcctgtttggggaagtcttacgcccaaatgtggagcctgatgtacttccacagacgtgacctcaggctggcggcaaatgctatttgctcggcagtcccatcacattgggttccaacaagtcgaacaacctggtccatacacgccagacatgagtggatgacaacggaagacatgctgacagtctggaacagggtgtggattcaagaaaacccatggatggaagacaaaactccagtggaatcatgggaggaaatcccatacctggggaaaagagaagaccaatggtgcggctcattgattgggctaacaagcagggccacctgggcaaagaacatccaaacagcaataaatcaggttagatccctaataggcaatgaggaatacacagactacatgccatccatgaaaagattcagaagagaagaggaagaggcaggagtcttgtggtag

SEQ ID NO: 7145 - RNA, 9876 nt, synthetic construct
  misc_feature 1..9876: note = derived and/or modified CDS sequence (wt) from DENV-2__EU056811__SS-prME
  source 1..9876: mol_type = other RNA
actgcaggcatgatcatcatgctgattccaacagtgatggcgtttcatctgaccacacgcaacggagaaccacacatgatcgtcagtagacaagaaaaagggaaaagccttctgtttaagacaaaggatggcacgaacatgtgcactcttatggccatggaccttggtgagttgtgtgaagacacaatcacgtataagtgtccttttctcaagcagaacgaaccagaagacatagattgttggtgcaactccacgtccacatgggtaacttacgggacatgtaccaccacaggagagcacagaagagaaaaaagatcagtggcgcttgttccacacgtgggaatgggattggagacacgaactgaaacatggatgtcatcagaaggggcctggaaacatgcccagagaattgaaacttggattctgagacatccaggttttaccataatggccgcaatcctggcatacactataggaacgacgcatttccaaagagtcctgatattcatcctactgacagccatcgctccttcaatgacaatgcgctgcataggaatatcaaatagggactttgtggaaggagtgtcaggagggagttgggttgacatagttttagaacatggaagttgtgtgacgacgatggcaaaaaataaaccaacattggactttgaactgataaaaacagaagccaaacaacccgccaccttaaggaagtactgtatagaggccaaactgaccaacacgacaacagactcgcgttgcccaacacaaggggaacccaccctgaatgaagagcaggacaaaaggtttgtctgcaaacattccatggtagacagaggatggggaaatggatgtggattgtttggaaaaggaggcatcgtgacctgtgctatgttcacatgcaaaaagaacatggaaggaaaaattgtgcagccagaaaacctggaatacactgtcgtgataacacctcactcaggggaagaacatgcagtcggaaatgacacaggaaaacatggtaaagaagtcaagataacaccacagagctccatcacagaggcggaactgacaggctatggcactgtaacgatggagtgctctccaagaacgggcctcgacttcaatgagatggtgttgctgcaaatggaagacaaagcttggctggtgcacagacaatggttcctagacctaccgttgccatggctgcccggagcggacacacaaggatcaaattggatacagaaagagacattggtcaccttcaaaaatccccatgcgaaaaaacaggatgttgttgtcctaggatcccaagagggggccatgcatacagcactcacaggggccacggaaatccaaatgtcatcaggaaacctgctgttcacaggacatctcaaatgcaggctgagaatggacaaattacaacttaaagggatgtcatactccatgtgcacaggaaaatttaagattgtgaaggaaatagcagaaacacaacatggaacaatagtcattagagtacaatatgaaggagacggctctccatgcaagatcccctttgagataatggatctagaaaaaagacatgttttgggccgcctgatcacagtcaatccaattgtaacagaaaaggacagtccagtcaacatagaagcagaacctccattcggagacagctacatcatcataggagtagaaccaggacaattaaagctggactggttcaagaaaggaagttccatcggtcaaatgtttgagacaacaatgaggggagcgaaaagaatggccatcttgggcgatacagcctgggattttggatctctgggaggagtgtttacatcaataggaaaagctctccaccaggttttcggagcaatctacggggctgcattcagtggggtttcatggactatgaagatcctcataggagttatcatcacatggataggaatgaactcacgcagcacatcactgtctgtgtcactggtattagtgggaatcgtgacactgtacttgggagttatggtgcaagccgatagtggttgcgttgtgagctggaagaacaaagaactaaaatgtggcagtggaatattcgtcacagataacgtgcatacatggacagaacaatacaagttccaaccagaatccccttcaaaactggcttcagccattcagaaagctcacgaagaaggcatctgtggaatccgctcagtaacaagactggaaaatcttatgtggaaacagataacatcagaattgaatcatattctatcagaaaatgaagtgaaactgaccatcatgacaggagacatcaaaggaatcatgcaggtaggaaaacgatctctgcggcctcaacctactgagttgaggtattcatggaaaacatggggtaaagcgaaaatgctctccacagaactccacaatcagaccttcctcattgatggtcccgaaacagcagaatgccccaacacaaacagagcttggaattcactagaagttgaggactatggctttggagtattcactaccaatatatggctaagattgagagaaaagcaagatgcattttgtgactcaaagctcatgtcagcggccataaaggacaacagagccgtccatgctgatatgggttattggatagaaagcgcactcaatgatacatggaagatagagaaagcttctttcattgaagtcaaaagttgccactggccaaagtcacacactctatggagtaatggagtgctagaaagcgagatggtaattccaaagaatatcgctggaccagtgtcacaacataataacagaccaggctatcacacacaaacagcaggaccttggcatctaggcaagcttgagatggactttgatttctgcgaagggaccacagtggtggtaaccgaagaatgtggaaacagagggccttctttaagaacaaccactgcctcaggaaaactcataacggaatggtgttgtcgatcttgcacactaccaccattaagatacagaggtgaggatggatgctggtacgggatggaaatcagaccattgaaagagaaagaagaaaatctggtcagctccctggtcacagccggacatgggcagattgataatttctcattaggaatcttgggaatggcgctgttccttgaagaaatgctcaggactcgagtaggaacgaaacatgcaatactactagttgcagtttctttcctaacgttaatcacagggaacatgtcttttagagacctgggaagagtgatggttatggtgggtgccaccatgacagatgacataggcatgggtgtgacttatcttgccctactagcagccttcaaagtcagaccaacctttgcagctggactgctcttgagaaaactgacctccaaggaattgatgatgaccaccataggaatcgttctcctctcccagagtagtataccagagactattcttgagctgaccgatgcgttagccttaggcatgatggtcctcaagatggtgagaaacatggaaaaatatcagctggcagtgactatcatggctattttgtgtgtcccaaatgctgtgatattacagaacgcatggaaagtgagttgcacaacactggcagtggtgtctgtttcccccctgctcttgacatcctcacagcagaaagcggactggatacctttagcgttgacgatcaaaggcctgaatcccacagccatttttctaacaaccctcacaagaaccagcaagaaaaggagctggcctttaaacgaggccatcatggcggttgggatggtgagtatcttggccagctctctcttgaagaacgacatccccatgacaggaccattagtggctggagggcttctcactgtgtgctacgtattaaccgggcggtcagccgatctggaactagagagagctaccgatgtcaaatgggatgatcaggcagagatatcaggtagcagtccaattctgtcaataacaatatcagaagatggcagcatgtcaataaagaatgaagaggaagagcaaacactgactatactcattagaacaggactgcttgtgatctcaggactctttccggtatcaataccaattacagcagcagcatggtacctgtgggaagtaaagaaacaacgggctggagtgttgtgggatgtcccctcaccaccacccgtgggaagggctgaattggaagatggagcctacagaatcaagcaaaaaggaattcttggatattcccagatcggagctggagtttacaaagaaggaacatttcacaccatgtggcacgtcacacgtggcgcagtcctaatgcataaggggaagaggattgaaccatcatgggcggacgtcaagaaagacttaatatcatatggaggaggttggaagctagaaggagaatggaaagaaggagaagaagtccaggtcttggcattggagcctgggaaaaatccaagagccgtccaaacaaaacctggcctttttagaaccaatactggaaccataggcgccgtatctctggacttttcccctgggacgtcaggatctccaatcgttgacaaaaaaggaaaagttgtaggtctctatggcaacggtgttgttacaaggggtggagcatatgtgagtgccatagctcagactgaaaaaggcattgaagacaatccagagattgaagatgacatctttcgaaagagaagattgactatcatggatctccacccaggagcaggaaagacaaagagatacctcccggccatagttagagaggccataaaaagaggcttgagaacactaatcctagcccccactagagtcgtggcagctgaaatggaggaagcccttagaggacttccaataagataccaaactccagctattagggctgagcacacagggcgggagatcgtggacttaatgtgtcacgccacatttaccatgaggctgctatcaccaatcagggtgccaaattacaacctgatcatcatggacgaagcccattttacagatccagcaagcatagcagctaggggatacatctcaactcgagtggagatgggtgaggcagctggaatttttatgacagccactcctccgggcagcagagatccatttcctcagagtaatgcaccaattatggacgaagaaagagaaattccggaacgttcatggaactccgggcacgagtgggtcacagattttaaaggaaagactgtctggtttgttccaagcataaaaaccggaaatgacatagcagcctgtctgagaaagaatggaaagagggtgatacaactcagtaggaagacctttgattctgaatacgtcaagactagaaccaatgactgggatttcgtggttacaactgacatttcggaaatgggtgccaactttaaagctgagagggttatagaccccagacgctgcatgaaaccagtcatactgacagacggcgaagagcgggtgattctagcaggacccatgccagtgacccactccagtgcagcacaaagaagagggagaataggaaggaatccaaggaatgaaaatgatcaatacatatatatgggagaacccctggaaaatgatgaagactgtgcgcactggaaggaagctaagatgctcctagataacatcaacacacctgaaggaatcattcccagcatgttcgagccagagcgtgaaaaggtggatgccattgacggtgaatatcgcttgagaggagaagcacggaaaacttttgtggacctaatgagaagaggagacctaccagtctggttggcttataaagtggcagctgaaggtatcaactacgcagacagaagatggtgttttgacggaaccagaaataatcaaatcttggaagaaaatgtggaagtggaaatctggacaaaggaaggggaaaggaaaaaattgaaacctagatggttagatgctaggatctactccgacccactggcgctaaaagaattcaaggaattcgcagccggaagaaagtccttaaccctgaacctaatcacagagatgggcagactcccaacttttatgactcagaaggccagagatgcactagacaacttagcggtgctgcacacggctgaagcgggtggaaaagcatacaatcatgccctcagtgaactaccggagaccctggagacactgcttttgctgacactgttggccacagtcacgggaggaatctttctattcctgatgagcggaaggggtatagggaagatgaccctgggaatgtgctgcataatcacggccagcatactcttatggtatgcacaaatacaaccacattggatagcagcttcaataatattggagttctttctcatagtattgctcatcccagaaccagaaaagcagaggacaccccaggataatcaattgacttatgtcattatagccatcctcacagtggtggccgcaaccatggcaaacgaaatgggttttctagaaaaaacaaagaaagacctcggactgggacacattgcaactcagcaacctgagagcaacattctggatatagatctacgtcctgcatcagcatggacgttgtatgccgtggcaacaacatttatcacaccaatgttgagacatagcattgaaaattcctcagtaaatgtgtccctaacagccatagctaaccaggccacagtgctaatgggtctcggaaaaggatggccattgtcaaagatggacattggagttcccctccttgccattgggtgttactcacaagtcaaccccataactctcacagcggctcttcttatgttagtagcacattatgccatcataggaccgggacttcaagccaaagcaaccagagaagctcagaaaagggcagcggcgggcatcatgaaaaacccaactgtggatggaataacagtgatagatctagatccaataccctatgatccaaagtttgaaaagcagttgggacaagtaatgctcctagtcctttgtgtgacccaagtgctgatgatgaggactacgtgggctttgtgtgaagccttaactctagcaaccggacccgtgtccacattgtgggaaggaaatccagggagattctggaacacaaccattgcagtgtcaatggcaaacatctttagagggagttaccttgctggagctggacttctcttttctatcatgaagaacacaactagcacgagaagaggaactggcaacatgggagaaacgctaggagagaaatggaaaaacagactgaacgcattggggaaaagtgaattccagatctacaaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggtttgaagaatgtaagagaagttaaaggcttaacaaaaggaggaccaggacacgaagaacctatccctatgtcaacatatgggtggaatctagtacgcttacagagcggagttgatgttttttttgttccaccagagaagtgtgacacattgttgtgtgacataggagaatcatcaccaaatcccacggtagaggcgggacgaacactcagagtccttaacctagtggaaaattggctgaacaataacacccaattttgcgtaaaggttcttaacccatacatgccctcagtcattgaaaggatggaaaccttacaacggaaatacggaggagccctggtgaggaatccactctcacggaattccacacatgaaatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaacattggaattgaaagtgagacaccgaacctagacataattgggaaaagaatagaaaaaataaaacaggagcatgaaacgtcatggcactatgaccaagaccatccatacaaaacatgggcttaccatggtagctatgaaacaaaacagacgggatcagcatcatccatggtgaacggagtagtcagactgctgacaaagccctgggacgttattccaatggtgacacagatggcaatgacagacacaactcctttcggacaacagcgtgtcttcaaagagaaggtggatacgagaactcaagaaccaaaagaaggcacaaaaaaactaatgaaaatcacagcagaatggctctggaaagaactaggaaagaaaaagacacctagaatgtgcaccagagaagaattcacaaaaaaggtaagaagcaatgcagccttgggggccatatttaccgatgagaacaagtggaagtcggcgcgtgaggctgttgaagacaataggttttgggagctggttgacaaggaaagaaacctccatcttgaaggaaaatgtgaaacatgtgtatacaacatgatgggaaaaagagagaaaaaactaggagagtttggtaaagcaaaaggcagcagagccatatggtacatgtggctcggagcacgcttcttagagtttgaagccctaggatttttgaatgaagaccattggttctccagagagaactccctgagtggagtggaaggagaagggctgcataaactaggttacatcttaagagaggtgagcaagaaagaaggaggagcaatgtatgccgatgataccgcaggctgggacacaagaatcacaatagaggatttaaaaaatgaagaaatgataacgaaccacatggcaggagaacacaagaaacttgccgaggccattttcaaattgacgtaccaaaacaaggtggtgcgtgtgcaaagaccaacaccaagaggcacggtaatggacatcatatcgagaagagaccaaaggggtagtggacaagttgtcacctatggcctcaacactttcaccaacatggaagcgcaactaattaggcaaatggagggggaaggagtcttcaaaagcatccagcacttgacagcctcagaagaaatcgctgtgcaagattggctagtaagagtagggcgtgaaaggctgtcaagaatggccatcagtggagatgattgtgttgtgaaacctttagatgacagatttgcaaaagctctaacagctctaaatgacatgggaaaggttaggaaggatatacagcaatgggagccctcaagaggatggaacgactggacacaggtgcccttctgctcacaccattttcacgagttaatcatgaaagatggccgcacacttgtagttccatgcagaaatcaagatgaattgatcggcagagcccgaatttcccagggagctgggtggtctttacgggagacggcctgtttgggaaagtcttacgcccaaatgtggagcctgatgtacttccatagacgtgatctcaggttagcggcaaatgccatttgctcggcagtcccgtcacactgggttccaacaagccggacaacctggtccatacacgccagccatgaatggatgacgacggaagacatgttgacagtttggaacagagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagatttagaagggaagaggaagaggcaggagttttgtggtag

SEQ ID NO: 7146 - RNA, 9876 nt, synthetic construct
  misc_feature 1..9876: note = derived and/or modified CDS sequence (wt) from DENV-2__DQ645545__SS-prME
  source 1..9876: mol_type = other RNA
actgcaggtgtaatcattatgatgattccaacagtggtggcgttccatttaaccacacgcaacggagaaccacacatgatcgtcagtagacaagagaaagggaaaagtcttctgtttaaaacagagaacggtgtgaacatgtgcacccttatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcacaaggggcctggaaacatgctcagagaatcgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgataaaaacggaagccaaacatccagccactttaaggaagtattgtatagaggcaaagctgaccaacacaacaacagcatctcgctgcccaacacaaggagaacccagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaggtaacaccacagagttccattacagaagcagaactgacaggttatggcaccgtcacgatggaatgctctccgagaacgggcctcgactttaatgagatggtgttgctgcaaatggaagacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacaggaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgcctttagcggggtttcatggactatgaaaatcctcataggagttgtcatcacatggataggaatgaattcacgcagcacctcactgtctgtgtcactagtattagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggtaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcacttaatgacacatggaagattgagaaagcctctttcattgaagttaaaagctgccattggccaaagtcacacactctctggagtaatggagtgctagaaagtgagatgataattccaaagaattttgcaggaccagtgtcacagcacaactacagaccaggctatcacacacaaacggcaggaccctggcacctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcaggccattgaaagagaaagaagagaacttggtcaactctttggtcacagccggacatggacagattgacaacttctcactaggagtcttgggaatggcattgttcctggaagaaatgctcaggacccgcgtaggaacgaaacatgcaatattgctagttgcagtttctttcgtgacattgatcacagggaacatgtcttttcgagatttggggagagtgatggtcatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctggctttggggatgatggttctcaaaatagtgagaaacatggaaaagtatcaactagcagtgactatcatggccatcttgtgcgtcccaaatgcagtgatattacaaaacgcatggaaagtgagctgcacaatactggcagtggtgtccgtttccccactgcttttaacatcatcacagcagaaagcagattggataccactggcgttgacgatcaaaggcctcaatccaacagccattttcttaacaaccctctcaagaactagcaagaaaaggagctggccactaaatgaggctattatggcagtcgggatggtgagcattttagctagttccctcttgaagaatgatattcccatgacaggaccattagtagctggagggcttctcactgtgtgttacgtgctcactggaagatcggctgatttggaactggagagagctgctgacgtaagatgggaagaacaggcagagatatcaggaagtagtccaattctgtcaataacaatatcggaagatggtagcatgtcgataaaaaatgaagaagaagaacaaacactgaccatactcattaggacaggactgctggtgatatcaggacttttccctgtgtcaataccaatcacggcagctgcatggtatctgtgggaagtgaaaaaacaacgagctggagtattgtgggatgtcccttcacccccacctgtgggaaaggccgaactggaagatggagcctatagaatcaagcagaaagggattctaggatactcgcagatcggggctggagtttacaaagaaggaacattccacacaatgtggcacgtcacacgcggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacactggaaccataggcgccgtatctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcattgaagacaatccagagattgaagatgacatctttcgaaagaaaagattgaccatcatggacctccacccaggggcgggaaaaacgaagagataccttccagcaatagtcagagaagccataaaacgaggcttgaggacactaatcctggcccccactagagttgtggcggctgaaatggaagaagctctcagaggacttccaataagataccaaacccccgccatcagagctgagcacactgggcgggagattgtggatctaatgtgtcacgccacatttaccatgaggctgctatccccaattagagtaccaaattacaacctaatcatcatggatgaagcccatttcacagacccagcaagcatagcagctagaggatacatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgaatgggtcacggattttaaagggaagactgtttggtttgttccaagcataaaagcaggaaatgatatagcagcttgcctgagaaagaatgggaagaaagtgatacaactcagcaggaagacctttgattctgaatatgtcaagactaggaccaatgattgggactttgtggtcacgacagacatttcagaaatgggcgctaacttcaaggctgagagggttatagaccccaggcgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagtatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaattacgcagacagaagatggtgctttgatggagtcaagaacaatcaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcactagacaacttagcagtcctgcatacggctgaagcaggcggaagggcgtacaatcatgctcttagtgaactgccggagaccctggagacattgcttttactgacactcttggctacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaggcattgcaacccagcaacctgagagcaacatcctggatatagatctacgtcctgcatcagcttggactctatatgctgtggcaacaactttcatcacaccaatgctgagacacagcattgaaaattcctcagtgaatgtgtctctaacggccattgctaaccaagccacagttttaatgggtcttgggaaaggatggccattgtcaaaaatggacatcggagttccccttctcgctatcgggtgctattcacaagttaaccccataactctcacggcggcccttctcttattggtagcacattatgccatcatagggccaggactccaagcgaaagcaactagagaagctcagaaaagagcagcagcgggcattatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgactgggcccatctccacactgtgggaaggaaatccagggagattttggaatacaactattgcagtatcaatggccaacatttttagagggagctacctggccggagccggacttctcttttctatcatgaagaatacggccaacacaagaaggggaactggcaacacaggagagacgcttggagaaaaatggaaaaaccgattgaatgcattggggaagagtgaattccagatctataagaaaagtggaatccaggaggtggatagaaccctagcaaaagaaggcatcaaaagaggagaaacggaccatcacgctgtgtcgcgaggctcggcgaaactgagatggttcgtcgagagaaacctggtcacaccagaagggaaagtaatggacctcggttgcggcagggggggctggtcatactattgtgggggactaaagaatgtaaaagaagtcaaaggcctaacaaaaggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaacatgatttcgagaatgttgattaacagattcacaatgagacataagaaggccacatacgagccagatgttgacctcggaagtggaacccgcaacatcggaattgaaagtgagacaccaaatttggacataattgggaaaagaatagaaaaaataaaacaagagcatgaaacatcatggcactatgaccaagaccacccatacaaaacgtgggcctaccatggcagctacgaaacaaaacagactggatcggcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaattaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagtttggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggatacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcagctgacagccacagaagaaattgcagtgaaaaactggttagcaagagtgggacgtgagaggttatcaagaatggctatcagtggagatgattgtgttgtgaaacccttagatgataggtttgcaagcgctctaacagctctaaatgacatgggaaaagttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtctctgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacttggtccatacatgccacacatgagtggatgacaacagaagatatgctgacagtctggaacagggtgtggattcaagaaaacccatggatagaagacaaaactccagtagaatcatgggaggaaatcccatatttggggaaaagagaagaccaatggtgcggctcattgatcgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 7147 - RNA, 9876 nt, synthetic construct
  misc_feature 1..9876: note = derived and/or modified CDS sequence (wt) from DENV-2__DQ645546__SS-prME
  source 1..9876: mol_type = other RNA
actgcaggtgtaatcattatgatgattccaacagtggtggcgttccatttaaccacacgcaacggagaaccacacatgatcgtcagtagacaagagaaagggaaaagtcttctgtttaaaacagagaacggtgtgaacatgtgcacccttatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgctcagagaatcgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgataaaaacggaagccaaacatccagccactttaaggaagtattgtatagaggcaaagctgaccaacacaacaacagcatctcgctgcccaacacaaggagaacccagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaggtaacaccacagagttccattacagaagcagaactgacaggttatggcaccgtcacgatggaatgctctccgagaacgggcctcgactttaatgagatggtgttgctgcaaatggaagacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgcctttagcggggtttcatggactatgaaaatcctcataggagttgtcatcacatggataggaatgaattcacgcagcacctcactgtctgtgtcactagtattagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggtaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcacttaatgacacatggaagattgagaaagcctctttcattgaagttaaaagctgccattggccaaagtcacacactctctggagtaatggagtgctagaaagtgagatgataattccaaagaattttgcaggaccagtgtcacagcacaactacagaccaggctatcacacacaaacggcaggaccctggcacctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcaggccattgaaagagaaagaagagaacttggtcaactctttggtcacagccggacatggacagattgacaacttctcactaggagtcttgggaatggcattgttcctggaagaaatgctcaggacccgcgtaggaacgaaacatgcaatattgctagttgcagtttctttcgtgacattgatcacagggaacatgtcttttcgagatttggggagagtgatggtcatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctggctttggggatgatggttctcaaaatagtgagaaacatggaaaagtatcaactagcagtgactatcatggccatcttgtgcgtcccaaatgcagtgatattacaaaacgcatggaaagtgagctgcacaatactggcagtggtgtccgtttccccactgcttttaacatcatcacagcagaaagcagattggataccactggcgttgacgatcaaaggcctcaatccaacagccattttcttaacaaccctctcaagaactagcaagaaaaggagctggccactaaatgaggctattatggcagtcgggatggtgagcattttagctagttccctcttgaagaatgatattcccatgacaggaccattagtagctggagggcttctcactgtgtgttacgtgctcactggaagatcggctgatttggaactggagagagctgctgacgtaagatgggaagaacaggcagagatatcaggaagtagtccaattctgtcaataacaatatcggaagatggtagcatgtcgataaaaaatgaagaagaagaacaaacactgaccatactcattaggacaggactgctggtgatatcaggacttttccctgtgtcaataccaatcacggcagctgcatggtatctgtgggaagtgaaaaaacaacgagctggagtattgtgggatgtcccttcacccccacctgtgggaaaggccgaactggaagatggagcctatagaatcaagcagaaagggattctaggatactcgcagatcggggctggagtttacaaagaaggaacattccacacaatgtggcacgtcacacgcggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacactggaaccataggcgccgtatctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcattgaagacaatccagagattgaagatgacatctttcgaaagaaaagattgaccatcatggacctccacccaggggcgggaaaaacgaagagataccttccagcaatagtcagagaagccataaaacgaggcttgaggacactaatcctggcccccactagagttgtggcggctgaaatggaagaagctctcagaggacttccaataagataccaaacccccgccatcagagctgagcacactgggcgggagattgtggatctaatgtgtcacgccacatttaccatgaggctgctatccccaattagagtaccaaattacaacctaatcatcatggatgaagcccatttcacagacccagcaagcatagcagctagaggatacatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgaatgggtcacggattttaaagggaagactgtttggtttgttccaagcataaaagcaggaaatgatatagcagcttgcctgagaaagaatgggaagaaagtgatacaactcagcaggaagacctttgattctgaatatgtcaagactaggaccaatgattgggactttgtggtcacgacagacatttcagaaatgggcgctaacttcaaggctgagagggttatagaccccaggcgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagtatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaattacgcagacagaagatggtgctttgatggagtcaagaacaatcaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcactagacaacttagcagtcctgcatacggctgaagcaggcggaagggcgtacaatcatgctcttagtgaactgccggagaccctggagacattgcttttactgacactcttggctacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaggcattgcaacccagcaacctgagagcaacatcctggatatagatctacgtcctgcatcagcttggactctatatgctgtggcaacaactttcatcacaccaatgctgagacacagcattgaaaattcctcagtgaatgtgtctctaacggccattgctaaccaagccacagttttaatgggtcttgggaaaggatggccattgtcaaaaatggacatcggagttccccttctcgctatcgggtgctattcacaagttaaccccataactctcacggcggcccttctcttattggtagcacattatgccatcatagggccaggactccaagcgaaagcaactagagaagctcagaaaagagcagcagcgggcattatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgactgggcccatctccacactgtgggaaggaaatccagggagattttggaatacaactattgcagtatcaatggccaacatttttagagggagctacctggccggagccggacttctcttttctatcatgaagaatacggccaacacaagaaggggaactggcaacacaggagagacgcttggagaaaaatggaaaaaccgattgaatgcattggggaagagtgaattccagatctataagaaaagtggaatccaggaggtggatagaaccctagcaaaagaaggcatcaaaagaggagaaacggaccatcacgctgtgtcgcgaggctcggcgaaactgagatggttcgtcgagagaaacctggtcacaccagaagggaaagtaatggacctcggttgcggcagggggggctggtcatactattgtgggggactaaagaatgtaaaagaagtcaaaggcctaacaaaaggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagtggaacccgcaacatcggaattgaaagtgagacaccaaatttggacataattgggaaaagaatagaaaaaataaaacaagagcatgaaacatcatggcactatgaccaagaccacccatacaaaacgtgggcctaccatggcagctacgaaacaaaacagactggatcggcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaattaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagtttggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggatacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcagctgacagccacagaagaaattgcagtgaaaaactggttagcaagagtgggacgtgagaggttatcaagaatggctatcagtggagatgattgtgttgtgaaacccttagatgataggtttgcaagcgctctaacagctctaaatgacatgggaaaagttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtctctgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacttggtccatacatgccacacatgagtggatgacaacagaagatatgctgacagtctggaacagggtgtggattcaagaaaacccatggatagaagacaaaactccagtagaatcatgggaggaaatcccatatttggggaaaagagaagaccaatggtgcggctcattgatcgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 7148 - RNA, 9876 nt, synthetic construct
  misc_feature 1..9876: note = derived and/or modified CDS sequence (wt) from DENV-2__DQ645547__SS-prME
  source 1..9876: mol_type = other RNA
actgcaggtgtaatcattatgatgattccaacagtggtggcgttccatttaaccacacgcaacggagaaccacacatgatcgtcagtagacaagagaaagggaaaagtcttctgtttaaaacagagaacggtgtgaacatgtgcacccttatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgctcagagaatcgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgataaaaacggaagccaaacatccagccactttaaggaagtattgtatagaggcaaagctgaccaacacaacaacagcatctcgctgcccaacacaaggagaacccagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaggtaacgccacagagttccattacagaagcagaactgacaggttatggcaccgtcacgatggaatgctctccgagaacgggcctcgactttaatgagatggtgttgctgcaaatggaagacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgcctttagcggggtttcatggactatgaaaatcctcataggagttgtcatcacatggataggaatgaattcacgcagcacctcactgtctgtgtcactagtattagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggtaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcacttaatgacacatggaagattgagaaagcctctttcattgaagttaaaagctgccattggccaaagtcacacactctctggagtaatggagtgctagaaagtgagatgataattccaaagaattttgcaggaccagtgtcacagcacaactacagaccaggctatcacacacaaacggcaggaccctggcacctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcaggccattgaaagagaaagaagagaacttggtcaactctttggtcacagccggacatggacagattgacaacttctcactaggagtcttgggaatggcattgttcctggaagaaatgctcaggacccgcgtaggaacgaaatatgcaatattgctagttgcagtttctttcgtgacattgatcacagggaacatgtcttttcgagatttggggagagtgatggtcatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctggctttggggatgatggttctcaaaatagtgagaaacatggaaaagtatcaactagcagtgactatcatggccatcttgtgcgtcccaaatgcagtgatattacaaaacgcatggaaagtgagctgcacaatactggcagtggtgtccgtttccccactgcttttaacatcatcacagcagaaagcagattggataccactggcgttgacgatcaaaggcctcaatccaacagccattttcttaacaaccctctcaagaactagcaagaaaaggagctggccactaaatgaggctattatggcagtcgggatggtgagcattttagctagttccctcttgaagaatgatattcccatgacaggaccattagtagctggagggcttctcactgtgtgttacgtgctcactggaagatcggctgatttggaactggagagagctgctgacgtaagatgggaagaacaggcagagatatcaggaagtagtccaattctgtcaataacaatatcggaagatggtagcatgtcgataaaaaatgaagaagaagaacaaacactgaccatactcattaggacaggactgctggtgatatcaggacttttccctgtgtcaataccaatcacggcagctgcatggtatctgtgggaagtgaaaaaacaacgagctggagtattgtgggatgtcccttcacccccacctgtgggaaaggccgaactggaagatggagcctatagaatcaagcagaaagggattctaggatactcgcagatcggggctggagtttacaaagaaggaacattccacacaatgtggcacgtcacacgcggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacactggaaccataggcgccgtatctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcattgaagacaatccagagattgaagatgacatctttcgaaagaaaagattgaccatcatggacctccacccaggggcgggaaaaacgaagagataccttccagcaatagtcagagaagccataaaacgaggcttgaggacactaatcctggcccccactagagttgtggcggctgaaatggaagaagctctcagaggacttccaataagataccaaacccccgccatcagagctgagcacactgggcgggagattgtggatctaatgtgtcacgccacatttaccatgaggctgctatccccaattagagtaccaaattacaacctaatcatcatggatgaagcccatttcacagacccagcaagcatagcagctagaggatacatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgaatgggtcacggattttaaagggaagactgtttggtttgttccaagcataaaagcaggaaatgatatagcagcttgcctgagaaagaatgggaagaaagtgatacaactcagcaggaagacctttgattctgaatatgtcaagactaggaccaatgattgggactttgtggtcacgacagacatttcagaaatgggcgctaacttcaaggctgagagggttatagaccccaggcgctgcatgaaaccagtcatactaacagacggtgaagagcgggtaatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagtatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaattacgcagacagaagatggtgctttgatggagtcaagaacaatcaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcactagacaacttagcagtcctgcatacggctgaagcaggcggaagggcgtacaatcatgctcttagtgaactgccggagaccctggagacattgcttttactgacactcttggctacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaggcattgcaacccagcaacctgagagcaacatcctggatatagatctacgtcctgcatcagcttggactctatatgctgtggcaacaactttcatcacaccaatgctgagacacagcattgaaaattcctcagtgaatgtgtctctaacggccattgctaaccaagccacagttttaatgggtcttgggaaaggatggccattgtcaaaaatggacatcggagttccccttctcgctatcgggtgctattcacaagttaaccccataactctcacggcggcccttctcttattggtagcacattatgccatcatagggccaggactccaagcgaaagcaactagagaagctcagaaaagagcagcagcgggcattatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgactgggcccatctccacactgtgggaaggaaatccagggagattttggaatacaactattgcagtatcaatggccaacatttttagagggagctacctggccggagccggacttctcttttctatcatgaagaatacggccaacacaagaaggggaactggcaacacaggagagacgcttggagaaaaatggaaaaaccgattgaatgcattggggaagagtgaattccagatctataagaaaagtggaatccaggaggtggatagaaccctagcaaaagaaggcatcaaaagaggagaaacggaccatcacgctgtgtcgcgaggctcggcgaaactgagatggttcgtcgagagaaacctggtcacaccagaagggaaagtaatggacctcggttgcggcagagggggctggtcatactattgtgggggactaaagaatgtaaaagaagtcaaaggcctaacaaaaggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagtggaacccgcaacatcggaattgaaagtgagacaccaaatttggacataattgggaaaagaatagaaaaaataaaacaagagcatgaaacatcatggcactatgaccaagaccacccatacaaaacgtgggcctaccatggcagctacgaaacaaaacagactggatcggcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaacctaaagaaggcacgaaaaaactaatgaaaatcacggcagaatggctctggaaagaattaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagtttggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggatacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcagctgacagccacagaagaaattgcagtgaaaaactggttagcaagagtgggacgtgagaggttatcaagaatggctatcagtggagatgattgtgttgtgaaacccttagatgataggtttgcaagcgctctaacagctctaaatgacatgggaaaagttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtctctgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacttggtccatacatgccacacatgagtggatgacaacagaagatatgctgacagtctggaacagggtgtggattcaagaaaacccatggatagaagacaaaactccagtagaatcatgggaggaaatcccatatttggggaaaagagaagaccaatggtgcggctcattgatcgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 7149 - RNA, 9876 nt, synthetic construct
  misc_feature 1..9876: note = derived and/or modified CDS sequence (wt) from DENV-2__DQ645549__SS-prME
  source 1..9876: mol_type = other RNA
actgcaggtgtaatcattatgatgattccaacagtggtggcgttccatttaaccacacgcaacggagaaccacacatgatcgtcagtagacaagagaaagggaaaagtcttctgtttaaaacagagaacggtgtgaacatgtgcacccttatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgctcagagaatcgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgataaaaacggaagccaaacatccagccactttaaggaagtattgtatagaggcaaagctgaccaacacaacaacagcatctcgctgcccaacacaaggagaacccagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaggtaacaccacagagttccattacagaagcagaactgacaggttatggcaccgtcacgatggaatgctctccgagaacgggcctcgactttaatgagatggtgttgctgcaaatggaagacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgcctttagcggggtttcatggactatgaaaatcctcataggagttgtcatcacatggataggaatgaattcacgcagcacctcactgtctgtgtcactagtattagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggtaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcacttaatgacacatggaagattgagaaagcctctttcattgaagttaaaagctgccattggccaaagtcacacactctctggagtaatggagtgctagaaagtgagatgataattccaaagaattttgcaggaccagtgtcacagcacaactacagaccaggctatcacacacaaacggcaggaccctggcacctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcaggccattgaaagagaaagaagagaacttggtcaactctttggtcacagccggacatggacagattgacaacttctcactaggagtcttgggaatggcattgttcctggaagaaatgctcaggacccgcgtaggaacgaaacatgcaatattgctagttgcagtttctttcgtgacattgatcacagggaacatgtcttttcgagatttggggagagtgatggtcatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctggctttggggatgatggttctcaaaatagtgagaaacatggaaaagtatcaactagcagtgactatcatggccatcttgtgcgtcccaaatgcagtgatattacaaaacgcatggaaagtgagctgcacaatactggcagtggtgtccgtttccccactgcttttaacatcatcacagcagaaagcagattggataccactggcgttgacgatcaaaggcctcaatccaacagccattttcttaacaaccctctcaagaactagcaagaaaaggagctggccactaaatgaggctattatggcagtcgggatggtgagcattttagctagttccctcttgaagaatgatattcccatgacaggaccattagtagctggagggcttctcactgtgtgttacgtgctcactggaagatcggctgatttggaactggagagagctgctgacgtaagatgggaagaacaggcagagatatcaggaagtagtccaattctgtcaataacaatatcggaagatggtagcatgtcgataaaaaatgaagaagaagaacaaacactgaccatactcattaggacaggactgctggtgatatcaggacttttccctgtgtcaataccaatcacggcagctgcatggtatctgtgggaagtgaaaaaacaacgagctggagtattgtgggatgtcccttcacccccacctgtgggaaaggccgaactggaagatggagcctatagaatcaagcagaaagggattctaggatactcgcagatcggggctggagtttacaaagaaggaacattccacacaatgtggcacgtcacacgcggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacactggaaccataggcgccgtatctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcattgaagacaatccagagattgaagatgacatctttcgaaagaaaagattgaccatcatggacctccacccaggggcgggaaaaacgaagagataccttccagcaatagtcagagaagccataaaacgaggcttgaggacactaatcctggcccccactagagttgtggcggctgaaatggaagaagctctcagaggacttccaataagataccaaacccccgccatcagagctgagcacactgggcgggagattgtggatctaatgtgtcacgccacatttaccatgaggctgctatccccaattagagtaccaaattacaacctaatcatcatggatgaagcccatttcacagacccagcaagcatagcagctagaggatacatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgaatgggtcacggattttaaagggaagactgtttggtttgttccaagcataaaagcaggaaatgatatagcagcttgcctgagaaagaatgggaagaaagtgatacaactcagcaggaagacctttgattctgaatatgtcaagactaggaccaatgattgggactttgtggtcacgacagacatttcagaaatgggcgctaacttcaaggctgagagggttatagaccccaggcgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagtatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaattacgcagacagaagatggtgctttgatggagtcaagaacaatcaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcactagacaacttagcagtcctgcatacggctgaagcaggcggaagggcgtacaatcatgctcttagtgaactgccggagaccctggagacattgcttttactgacactcttggctacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagctatccttacagtggtggccgcaaccatggcaaacgagatgggtttcctggaaaaaacaaagaaagatttcggattgggaggcattgcaacccagcaacctgagagcaacatcctggatatagatctacgtcctgcatcagcttggactctatatgctgtggcaacaactttcatcacaccaatgctgagacacagcattgaaaattcctcagtgaatgtgtctctaacggccattgctaaccaagccacagttttaatgggtcttgggaaaggatggccattgtcaaaaatggacatcggagttccccttctcgctatcgggtgctattcacaagttaaccccataactctcacggcggcccttctcttattggtagcacattatgccatcatagggccaggactccaagcgaaagcaactagagaagctcagaaaagagcagcagcgggcattatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgactgggcccatctccacactgtgggaaggaaatccagggagattttggaatacaactattgcagtatcaatggccaacatttttagagggagctacctggccggagccggacttctcttttctatcatgaagaatacggccaacacaagaaggggaactggcaacacaggagagacgcttggagaaaaatggaaaaaccgattgaatgcattggggaagagtgaattccagatctataagaaaagtggaatccaggaggtggatagaaccctagcaaaagaaggcatcaaaagaggagaaacggaccatcacgctgtgtcgcgaggctcggcgaaactgagatggttcgtcgagagaaacctggtcacaccagaagggaaagtaatggacctcggttgcggcagggggggctggtcatactattgtgggggactaaagaatgtaaaagaagtcaaaggcctaacaaaaggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagtggaacccgcaacatcggaattgaaagtgagacaccaaatttggacataattgggaaaagaatagaaaaaataaaacaagagcatgaaacatcatggcactatgaccaagaccacccatacaaaacgtgggcctaccatggcagctacgaaacaaaacagactggatcggcatcatccatggtgaacggagtggttaggctgctaacaaaaccttgggacgtcatccctatggtgacacagatggcaatgacagacacgactccatttggacaacagcgcgttttcaaagtgaaagtggacacgagaacccaagaaccgaaagaaggcacgaaaaaactaatgaaaatcacggcagaatggctctggaaagaattaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagtttggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggatacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcagctgacagccacagaagaaattgcagtgaaaaactggttagcaagagtgggacgtgagaggttatcaagaatggctatcagtggagatgattgtgttgtgaaacccttagatgataggtttgcaagcgctctaacagctctaaatgacatgggaaaagttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtctctgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacttggtccatacatgccacacatgagtggatgacaacagaagatatgctgacagtctggaacagggtgtggattcaagaaaacccatggatagaagacaaaactccagtagaatcatgggaggaaatcccatatttggggaaaagagaagaccaatggtgcggctcattgatcgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 7150 - RNA, 9876 nt, synthetic construct
  misc_feature 1..9876: note = derived and/or modified CDS sequence (wt) from DENV-2__DQ645550__SS-prME
  source 1..9876: mol_type = other RNA
actgcaggtgtaatcattatgatgattccaacagtggtggcgttccatttaaccacacgcaacggagaaccacacatgatcgtcagtagacaagagaaagggaaaagtcttctgtttaaaacagagaacggtgtgaacatgtgcacccttatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgctcagagaatcgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgataaaaacggaagccaaacatccagccactttaaggaagtattgtatagaggcaaagctgaccaacacaacaacagcatctcgctgcccaacacaaggagaacccagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaggtaacaccacagagttccattacagaagcagaactgacaggttatggcaccgtcacgatggaatgctctccgagaacgggcctcgactttaatgagatggtgttgctgcaaatggaagacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgcctttagcggggtttcatggactatgaaaatcctcataggagttgtcatcacatggataggaatgaattcacgcagcacctcactgtctgtgtcactagtattagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggtaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcacttaatgacacatggaagattgagaaagcctctttcattgaagttaaaagctgccattggccaaagtcacacactctctggagtaatggagtgctagaaagtgagatgataattccaaagaattttgcaggaccagtgtcacagcacaactacagaccaggctatcacacacaaacggcaggaccctggcacctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcaggccattgaaagagaaagaagagaacttggtcaactctttggtcacagccggacatggacagattgacaacttctcactaggagtcctgggaatggcattgttcctggaagaaatgctcaggacccgcgtaggaacgaaacatgcaatattgctagttgcagtttctttcgtgacattgatcacagggaacatgtcttttcgagatttggggagagtgatggtcatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctggctttggggatgatggttctcaaaatagtgagaaacatggaaaagtatcaactagcagtgactatcatggccatcttgtgcgtcccaaatgcagtgatattacaaaacgcatggaaagtgagctgcacaatactggcagtggtgtccgtttccccactgcttttaacatcatcacagcagaaagcagattggataccactggcgttgacgatcaaaggcctcaatccaacagccattttcttaacaaccctctcaagaactagcaagaaaaggagctggccactaaatgaggctattatggcagtcgggatggtgagcattttagctagttccctcttgaagaatgatattcccatgacaggaccattagtagctggagggcttctcactgtgtgttacgtgctcactggaagatcggctgatttggaactggagagagctgctgacgtaagatgggaagaacaggcagagatatcaggaagtagtccaattctgtcaataacaatatcggaagatggtagcatgtcgataaaaaatgaagaagaagaacaaacactgaccatactcattaggacaggactgctggtgatatcaggacttttccctgtgtcaataccaatcacggcagctgcatggtatctgtgggaagtgaaaaaacaacgagctggagtattgtgggatgtcccttcacccccacctgtgggaaaggccgaactggaagatggagcctatagaatcaagcagaaagggattctaggatactcgcagatcggggctggagtttacaaagaaggaacattccacacaatgtggcacgtcacacgcggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacactggaaccataggcgccgtatctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcattgaagacaatccagagattgaagatgacatctttcgaaagaaaagattgaccatcatggacctccacccaggggcgggaaaaacgaagagataccttccagcaatagtcagagaagccataaaacgaggcttgaggacactaatcctggcccccactagagttgtggcggctgaaatggaagaagctctcagaggacttccaataagataccaaacccccgccatcagagctgagcacactgggcgggagattgtggatctaatgtgtcacgccacatttaccatgaggctgctatccccaattagagtaccaaattacaacctaatcatcatggatgaagcccatttcacagacccagcaagcatagcagctagaggatacatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgaatgggtcacggattttaaagggaagactgtttggtttgttccaagcataaaagcaggaaatgatatagcagcttgcctgagaaagaatgggaagaaagtgatacaactcagcaggaagacctttgattctgaatatgtcaagactaggaccaatgattgggactttgtggtcacgacagacatttcagaaatgggcgctaacttcaaggctgagagggttatagaccccaggcgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagtatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaattacgcagacagaagatggtgctttgatggagtcaagaacaatcaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcactagacaacttagcagtcctgcatacggctgaagcaggcggaagggcgtacaatcatgctcttagtgaactgccggagaccctggagacattgcttttactgacactcttggctacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaggcattgcaacccagcaacctgagagtaacatcctggatatagatctacgtcctgcatcagcttggactctatatgctgtggcaacaactttcatcacaccaatgctgagacacagcattgaaaattcctcagtgaatgtgtctctaacggccattgctaaccaagccacagttttaatgggtcttgggaaaggatggccattgtcaaaaatggacatcggagttccccttctcgctatcgggtgctattcacaagttaaccccataactctcacggcggcccttctcttattggtagcacattatgccatcatagggccaggactccaagcgaaagcaactagagaagctcagaaaagagcagcagcgggcattatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgactgggcccatctccacactgtgggaaggaaatccagggagactttggaatacaactattgcagtatcaatggccaacatttttagagggagctacctggccggagccggacttctcttttctatcatgaagaatacggccaacacaagaaggggaactggcaacacaggagagacgcttggagaaaaatggaaaaaccgattgaatgcattggggaagagtgaattccagatctataagaaaagtggaatccaggaggtggatagaaccctagcaaaagaaggcatcaaaagaggagaaacggaccatcacgctgtgtcgcgaggctcggcgaaactgagatggttcgtcgagagaaacctggtcacaccagaagggaaagtaatggacctcggttgcggcagagggggctggtcatactattgtgggggactaaagaatgtaaaagaagtcaaaggcctaacaaaaggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagtggaacccgcaacattggaattgaaagtgagacaccaaatttggacataattgggaaaagaatagaaaaaataaaacaagagcatgaaacatcatggcactatgaccaagaccacccatacaaaacgtgggcctaccatggcagctacgaaacaaaacagactggatcggcatcatccatggtgaacggagtggttaggctgctaacaaaaccttgggacgtcatccctatggtgacacagatggcaatgacagacacgactccatttggacaacagcgcgttttcaaagtgaaagtggacacgagaacccaagaacctaaagaaggcacgaaaaaactaatgaaaatcacggcagaatggctctggaaagaattaggaaagaaaaagacacctagaatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagtttggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggatacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcagctgacagccacagaagaaattgcagtgaaaaactggttagcaagagtgggacgtgagaggttatcaagaatggctatcagtggagatgattgtgttgtgaaacccttagatgataggtttgcaagcgctctaacagctctaaatgacatgggaaaagttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtctctgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacttggtccatacatgccacacatgagtggatgacaacagaagatatgctgacagtctggaacagggtgtggattcaagaaaacccatggatagaagacaaaactccagtagaatcatgggaggaaatcccatatttggggaaaagagaagaccaatggtgcggctcattgatcgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 7151 - RNA, 9876 nt, synthetic construct
  misc_feature 1..9876: note = derived and/or modified CDS sequence (wt) from DENV-2__DQ645551__SS-prME
  source 1..9876: mol_type = other RNA
actgcaggtgtaatcattatgatgattccaacagtggtggcgttccatttaaccacacgcaacggagaaccacacatgatcgtcagtagacaagagaaagggaaaagtcttctgtttaaaacagagaacggtgtgaacatgtgcacccttatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgctcagagaatcgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgataaaaacggaagccaaacatccagccactttaaggaagtattgtatagaggcaaagctgaccaacacaacaacagcatctcgctgcccaacacaaggagaacccagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaggtaacaccacagagttccattacagaagcagaactgacaggttatggcaccgtcacgatggaatgctctccgagaacgggcctcgactttaatgagatggtgttgctgcaaatggaagacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgcctttagcggggtttcatggactatgaaaatcctcataggagttgtcatcacatggataggaatgaattcacgcagcacctcactgtctgtgtcactagtattagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggtaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcacttaatgacacatggaagattgagaaagcctctttcattgaagttaaaagctgccattggccaaagtcacacactctctggagtaatggagtgctagaaagtgagatgataattccaaagaattttgcaggaccagtgtcacagcacaactacagaccaggctatcacacacaaacggcaggaccctggcacctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcaggccattgaaagagaaagaagagaacttggtcaactctttggtcacagccggacatggacagattgacaacttctcactaggagtcttgggaatggcattgttcctggaagaaatgctcaggacccgcgtaggaacgaaacatgcaatattgctagttgcagtttctttcgtgacattgatcacagggaacatgtcttttcgagatttggggagagtgatggtcatggtgggcgctactatgacggatgacataggcatgggcgtgacttatcttgccctattagcagccttcaaagtcagaccaacttttgcagctggactactcttgagaaagctgacctccaaggaattaatgatgaccacaataggaatcgtactcctctctcagagcaccataccagagactatacttgaactgactgacgcgctggctttggggatgatggttctcaaaatagtgagaaacatggaaaagtatcaactagcagtgactatcatggccatcttgtgcgtcccaaatgcagtgatattacaaaacgcatggaaagtgagctgcacaatactggcagtggtgtccgtttccccactgcttttaacatcatcacagcagaaagcagattggataccactggcgttgacgatcaaaggcctcaatccaacagccattttcttaacaaccctctcaagaactagcaagaaaaggagctggccactaaatgaggctattatggcagtcgggatggtgagcattttagctagttccctcttgaagaatgatattcccatgacaggaccattagtagctggagggcttctcactgtgtgttacgtgctcactggaagatcggctgatttggaactggagagagctgctgacgtaagatgggaagaacaggcagagatatcaggaagtagtccaattctgtcaataacaatatcggaagatggtagcatgtcgataaaaaatgaagaagaagaacaaacactgaccatactcattaggacaggactgctggtgatatcaggacttttccctgtgtcaataccaatcacggcagctgcatggtatctgtgggaagtgaaaaaacaacgagctggagtattgtgggatgtcccttcacccccacctgtgggaaaggccgaactggaagatggagcctatagaatcaagcagaaagggattctaggatactcgcagatcggggctggagtttacaaagaaggaacattccacacaatgtggcacgtcacacgcggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacactggaactataggcgccgtatctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcattgaagacaatccagagattgaagatgacatctttcgaaagaaaagattgaccatcatggacctccacccaggggcgggaaaaacgaagagataccttccagcaatagtcagagaagccataaaacgaggcttgaggacactaatcctggcccccactagagttgtggcggctgaaatggaagaagctctcagaggacttccaataagataccaaacccccgccatcagagctgagcacactgggcgggagattgtggatctaatgtgtcacgccacatttaccatgaggctgctatccccaattagagtaccaaattacaacctaatcatcatggatgaagcccatttcacagacccagcaagcatagcagctagaggatacatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgaatgggtcacggattttaaagggaagactgtttggtttgttccaagcataaaagcaggaaatgatatagcagcttgcctgagaaagaatgggaagaaagtgatacaactcagcaggaagacctttgattctgaatatgtcaagactaggaccaatgattgggactttgtggtcacgacagacatttcagaaatgggcgctaacttcaaggctgagagggttatagaccccaggcgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacattaacacgcctgaaggaatcattcccagtatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaattacacagacagaagatggtgctttgatggagtcaagaacaatcaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcactagacaacttagcagtcctgcatacggctgaagcaggcggaagggcgtacaatcatgctcttagtgaactgccggagaccctggagacattgcttttactgacactcttggctacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaggcattgcaacccagcaacctgagagcaacatcctggatatagatctacgtcctgcatcagcttggactctatatgctgtggcaacaactttcatcacaccaatgctgagacacagcattgaaaattcctcagtgaatgtgtctctaacggccattgctaaccaagccacagttttaatgggtcttgggaaaggatggccattgtcaaaaatggacatcggagttccccttctcgctatcgggtgctattcacaagttaaccccataactctcacggcggcccttctcttattggtagcacattatgccatcatagggccaggactccaagcgaaagcaactagagaagctcagaaaagagcagcagcgggcattatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgactgggcccatctccacactgtgggaaggaaatccagggagattttggaatacaactattgcagtatcaatggccaacatttttagagggagctacctggccggagccggacttctcttttctatcatgaagaatacggccaacacaagaaggggaactggcaacacaggagagacgcttggagaaaaatggaaaaaccgattgaatgcattggggaagagtgaattccagatctataagaaaagtggaatccaggaggtggatagaaccctagcaaaagaaggcatcaaaagaggagaaacggaccatcacgctgtgtcgcgaggctcggcgaaactgagatggttcgtcgagagaaacctggtcacaccagaagggaaagtaatggacctcggttgcggcagggggggctggtcatactattgtgggggactaaagaatgtaaaagaagtcaaaggcctaacaaaaggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagtggaacccgcaacatcggaattgaaagtgagacaccaaatttggacataattgggaaaagaatagaaaaaataaaacaagagcatgaaacatcatggcactatgaccaagaccacccatacaaaacgtgggcctaccatggcagctacgaaacaaaacagactggatcggcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaattaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagtttggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggatacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcagctgacagccacagaagaaattgcagtgaaaaactggttagcaagagtgggacgtgagaggttatcaagaatggctatcagtggagatgattgtgttgtgaaacccttagatgataggtttgcaagcgctctaacagctctaaatgacatgggaaaagttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtctctgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacttggtccatacatgccacacatgagtggatgacaacagaagatatgctgacagtctggaacagggtgtggattcaagaaaacccatggatagaagacaaaactccagtagaatcatgggaggaaatcccatatttggggaaaagagaagaccaatggtgcggctcattgatcgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 7152 - RNA, 9876 nt, synthetic construct
  misc_feature 1..9876: note = derived and/or modified CDS sequence (wt) from DENV-2__DQ645552__SS-prME
  source 1..9876: mol_type = other RNA
actgcaggtgtaatcattatgatgattccaacagtggtggcgttccatttaaccacacgcaacggagaaccacacatgatcgtcagtagacaagagaaagggaaaagtcttctgtttaaaacagagaacggtgtgaacatgtgcacccttatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgctcagagaatcgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgataaaaacggaagccaaacatccagccactttaaggaagtattgtatagaggcaaagctgaccaacacaacaacagcatctcgctgcccaacacaaggagaacccagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaggtaacaccacagagttccattacagaagcagaactgacaggttatggcaccgtcacgatggaatgctctccgagaacgggcctcgactttaatgagatggtgttgctgcaaatggaagacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgcctttagcggggtttcatggactatgaaaatcctcataggagttgtcatcacatggataggaatgaattcacgcagcacctcactgtctgtgtcactagtattagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggtaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcacttaatgacacatggaagattgagaaagcctctttcattgaagttaaaagctgccattggccaaagtcacacactctctggagtaatggagtgctagaaagtgagatgataattccaaagaattttgcaggaccagtgtcacagcacaactacagaccaggctatcacacacaaacggcaggaccctggcacctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcaggccattgaaagagaaagaagagaacttggtcaactctttggtcacagccggacatggacagattgacaacttctcactaggagtcttgggaatggcattgttcctggaagaaatgctcaggacccgcgtaggaacgaaacatgcaatattgctagttgcagtttctttcgtgacattgatcacagggaacatgtcttttcgagatttggggagagtgatggtcatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctggctttggggatgatggttctcaaaatagtgagaaacatggaaaagtatcaactagcagtgactatcatggccatcctgtgcgtcccaaatgcagtgatattacaaaacgcatggaaagtgagctgcacaatactggcagtggtgtccgtttccccactgcttttaacatcatcacagcagaaagcagattggataccactggcgttgacgatcaaaggcctcaatccaacagccattttcttaacaaccctctcaagaactagcaagaaaaggagctggccactaaatgaggctattatggcagtcgggatggtgagcattttagctagttccctcttgaagaatgacattcccatgacaggaccattagtagctggagggcttctcactgtgtgttacgtgctcactggaagatcggctgatttggaactggagagagctgctgacgtaagatgggaagaacaggcagagatatcaggaagtagtccaattctgtcaataacaatatcggaagatggtagcatgtcgataaaaaatgaagaagaagaacaaacactgaccatactcattaggacaggactgctggtgatatcaggacttttccctgtgtcaataccaatcacggcagctgcatggtatctgtgggaagtgaaaaaacaacgagctggagtattgtgggatgtcccttcacccccacctgtgggaaaggccgaactggaagatggagcctatagaatcaagcagaaagggattctaggatactcgcagatcggggctggagtttacaaagaaggaacattccacacaatgtggcacgtcacacgcggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacactggaaccataggcgccgtatctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcattgaagacaatccagagattgaagatgacatctttcgaaagaaaagattgaccatcatggacctccacccaggggcgggaaaaacgaagagataccttccagcaatagtcagagaagccataaaacgaggcttgaggacactaatcctggcccccactagagttgtggcggctgaaatggaagaagctctcagaggacttccaataagataccaaacccccgccatcagagctgagcacactgggcgggagattgtggatctaatgtgtcacgccacatttaccatgaggctgctatccccaattagagtaccaaattacaacctaatcatcatggatgaagcccatttcacagacccagcaagcatagcagctagaggatacatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgaatgggtcacggattttaaagggaagactgtttggtttgttccaagcataaaagcaggaaatgatatagcagcttgcctgagaaagaatgggaagaaagtgatacaactcagcaggaagacctttgattctgaatatgtcaagactaggaccaatgattgggactttgtggtcacgacagacatttcagaaatgggcgctaacttcaaggctgagagggttatagaccccaggcgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagtatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaattacgcagacagaagatggtgctttgatggagtcaagaacaatcaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcactagacaacttagcagtcctgcatacggctgaagcaggcggaagggcgtacaatcatgctcttagtgaactgccggagaccctggagacattgcttttactgacactcttggctacagtcacgggcggaatcttcctattcttgatgagtggaaaaggcatagggaagatgaccctgggaatgtgctgcataatcacggccagtgttctcctgtggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaggcattgcaacccagcaacctgagagcaacatcctggatatagatctacgtcctgcatcagcttggactctatatgctgtggcaacaactttcatcacaccaatgctgagacacagcattgaaaattcctcagtgaatgtgtctctaacggccattgctaaccaagccacagttttaatgggtcttgggaaaggatggccattgtcaaaaatggacatcggagttccccttctcgctatcgggtgctattcacaagttaaccccataactctcacggcggcccttctcttattggtagcacattatgccatcatagggccaggactccaagcgaaagcaactagagaagctcagaaaagagcagcagcgggcattatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgactgggcccatctccacactgtgggaaggaaatccagggagattttggaatacaactattgcagtatcaatggccaacatttttagagggagctacctggccggagccggacttctcttttctatcatgaagaatacggccaacacaagaaggggaactggcaacacaggagagacgcttggagaaaaatggaaaaaccgattgaatgcattggggaagagtgaattccagatctataagaaaagtggaatccaggaggtggatagaaccctagcaaaagaaggcatcaaaagaggagaaacggaccatcacgctgtgtcgcgaggctcggcgaaactgagatggttcgtcgagagaaacctggtcacaccagaagggaaagtaatggacctcggttgcggcagggggggctggtcatactattgtgggggactaaagaatgtaaaagaagtcaaaggcctaacaaaaggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagtggaacccgcaacatcggaattgaaagtgagacaccaaatttggacataattgggaaaagaatagaaaaaataaaacaagagcatgaaacatcatggcactatgaccaagaccacccatacaaaacgtgggcctaccatggcagctacgaaacaaaacagactggatcggcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaattaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagtttggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgataccgcaggatgggatacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacatcaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcagctgacagccacagaagaaattgcagtgaaaaactggttagcaagagtgggacgtgagaggttatcaagaatggctatcagtggagatgattgtgttgtgaaacccttagatgataggtttgcaagcgctctaacagctctaaatgacatgggaaaagttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtctctgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacttggtccatacatgccacacatgagtggatgacaacagaagatatgctgacagtctggaacagggtgtggattcaagaaaacccatggatagaagacaaaactccagtagaatcatgggaggaaatcccatatttggggaaaagagaagaccaatggtgcggctcattgatcgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 7153 - RNA, 9876 nt, synthetic construct
  misc_feature 1..9876: note = derived and/or modified CDS sequence (wt) from DENV-2__DQ645553__SS-prME
  source 1..9876: mol_type = other RNA
actgcaggtgtaatcattatgatgattccaacagtggtggcgttccatttaaccacacgcaacggagaaccacacatgatcgtcagtagacaagagaaagggaaaagtcttctgtttaaaacagagaacggtgtgaacatgtgcacccttatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgctcagagaatcgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagttgggttgacatagtcttagaacatggaagctgtgtgacgacgatggcgaaaaataaaccaacattggattttgaactgataaaaacggaagccaaacatccagccactttaaggaagtattgtatagaggcaaagctgaccaacacaacaacagcatctcgctgcccaacacaaggagaacccagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaggtaacaccacagagttccattacagaagcagaactgacaggttatggcaccgtcacgatggaatgctctccgagaacgggcctcgactttaatgagatggtgttgctgcaaatggaagacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccccgggaggagtgttcacatctataggaaaggccctccaccaagtctttggagcaatctatggggctgcctttagcggggtttcatggactatgaaaatcctcataggagttgtcatcacatggataggaatgaattcacgcagcacctcactgtctgtgtcactagtattagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggtaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcacttaatgacacatggaagattgagaaagcctctttcattgaagttaaaagctgccattggccaaagtcacacactctctggagtaatggagtgctagaaagtgagatgataattccaaagaattttgcaggaccagtgtcacagcacaactacagaccaggctatcacacacaaacggcaggaccctggcacctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcaggccattgaaagagaaagaagagaacttggtcaactctctggtcacagccggacatggacagattgacaacttctcactaggagtcttgggaatggcattgttcctggaagaaatgctcaggacccgcgtaggaacgaaacatgcaatattgctagttgcagtttctttcgtgacattgatcacagggaacatgtcttttcgagatttggggagagtgatggtcatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctggctttggggatgatggttctcaaaatagtgagaaacatggaaaagtatcaactagcagtgactatcatggccatcttgtgcgtcccaaatgcagtgatattacaaaacgcatggaaagtgagctgcacaatactggcagtggtgtccgtttccccactgcttttaacatcatcacagcagaaagcagattggataccactggcgttgacgatcaaaggcctcaatccaacagccattttcttaacaaccctctcaagaactagcaagaaaaggagctggccactaaatgaggctattatggcagtcgggatggtgagcattttagctagttccctcttgaagaatgatattcccatgacaggaccattagtagctggagggcttctcactgtgtgttacgtgctcactggaagatcggctgatttggaactggagagagctgctgacgtaagatgggaagaacaggcagagatatcaggaagtagtccaattctgtcaataacaatatcggaagatggtagcatgtcgataaaaaatgaagaagaagaacaaacactgaccatactcattaggacaggactgctggtgatatcaggacttttccctgtgtcaataccaatcacggcagctgcatggtatctgtgggaagtgaaaaaacaacgagctggagtattgtgggatgtcccttcacccccacctgtgggaaaggccgaactggaagatggagcctatagaatcaagcagaaagggattctaggatactcgcagatcggggctggagtttacaaagaaggaacattccacacaatgtggcacgtcacacgcggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaaaaatccaagagccgtccaaacaaaacccggtctcttcaaaactaacactggaaccataggcgccgtatctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcattgaagacaatccagagattgaagatgacatctttcgaaagaaaagattgaccatcatggacctccacccaggggcgggaaaaacgaagagataccttccagcaatagtcagagaagccataaaacgaggcttgaggacactaatcctggcccccactagagttgtggcggctgaaatggaagaagctctcagaggacttccaataagataccaaacccccgccatcagagctgagcacactgggcgggagattgtggatctaatgtgtcacgccacatttaccatgaggctgctatccccaattagagtaccaaattacaacctaatcatcatggatgaagcccatttcacagacccagcaagcatagcagctagaggatacatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgaatgggtcacggattttaaagggaagactgtttggtttgttccaagcataaaagcaggaaatgatatagcagcttgcctgagaaagaatgggaagaaagtgatacaactcagcaggaagacctttgattctgaatatgtcaagactaggaccaatgattgggactttgtggtcacgacagacatttcagaaatgggcgctaacttcaaggctgagagggttatagaccccaggcgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagtatgttcgaaccagagcgtgaaaaggtggatgccattgatggtgaataccgcttaagaggagaagcgaggaaaactttcgtggacctaatgagaagaggagacctaccagtctggctagcctacagagtggcagctgaaggtatcaattacgcagacagaagatggtgctttgatggagtcaagaacaatcaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcactagacaacttagcagtcctgcatacggctgaagcaggcggaagggcgtacaatcatgctcttagtgaactgccggagaccctggagacattgcttttactgacactcttggctacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaggcattgcaacccagcaacctgagagcaacatcctggatatagatctacgtcctgcatcagcttggactctatatgctgtggcaacaactttcatcacaccaatgctgagacacagcattgaaaattcctcagtgaatgtgtctctaacggccattgctaaccaagccacagttttaatgggtcttgggaaaggatggccattgtcaaaaatggacatcggagttccccttctcgctatcgggtgctattcacaagttaaccccataactctcacggcggcccttctcttattggtagcacattatgccatcatagggccaggactccaagcgaaagcaactagagaagctcagaaaagagcagcagcgggcattatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgactgggcccatctccacactgtgggaaggaaatccagggagattttggaatacaactattgcagtatcaatggccaacatttttagagggagctacctggccggagccggacttctcttttctatcatgaagaatacggccaacacaagaaggggaactggcaacacaggagagacgcttggagaaaaatggaaaaaccgattgaatgcattggggaagagtgaattccagatctataagaaaagtggaatccaggaggtggatagaaccctagcaaaagaaggcatcaaaagaggagaaacggaccatcacgctgtgtcgcgaggctcggcgaaactgagatggttcgtcgagagaaacctggtcacaccagaagggaaagtaatggacctcggttgcggcagggggggctggtcatactattgtgggggactaaagaatgtaaaagaagtcaaaggcctaacaaaaggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagtggaacccgcaacatcggaattgaaagtgagacaccaaatttggacataattgggaaaagaatagaaaaaataaaacaagagcatgaaacatcatggcactatgaccaagaccacccatacaaaacgtgggcctaccatggcagctacgaaacaaaacagactggatcggcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaattaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagtttggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggatacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcagctgacagccacagaagaaattgcagtgaaaaactggttagcaagagtgggacgtgagaggttatcaagaatggctatcagtggagatgattgtgttgtgaaacccttagatgataggtttgcaagcgctctaacagctctaaatgacatgggaaaagttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtctctgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacttggtccatacatgccacacatgagtggatgacaacagaagatatgctggcagtctggaacagggtgtggattcaagaaaacccatggatagaagacaaaactccagtagaatcatgggaggaaatcccatatttggggaaaagagaagaccaatggtgcggctcattgatcgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 7154 - RNA, 9876 nt, synthetic construct
  misc_feature 1..9876: note = derived and/or modified CDS sequence (wt) from DENV-2__DQ645554__SS-prME
  source 1..9876: mol_type = other RNA
actgcaggtgtaatcattatgatgattccaacagtggtggcgttccatttaaccacacgcaacggagaaccacacatgatcgtcagtagacaagagaaagggaaaagtcttctgtttaaaacagagaacggtgtgaacatgtgcacccttatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgctcagagaatcgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgataaaaacggaagccaaacatccagccactttaaggaagtattgtatagaggcaaagctgaccaacacaacaacagcatctcgctgcccaacacaaggagaacccagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaggtaacaccacagagttccattacagaagcagaactgacaggttatggcaccgtcacgatggaatgctctccgagaacgggcctcgactttaatgagatggtgttgctgcaaatggaagacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaatccaattgttacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgcctttagcggggtttcatggactatgaaaatcctcataggagttgtcatcacatggataggaatgaattcacgcagcacctcactgtctgtgtcactagtattagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggtaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcacttaatgacacatggaagattgagaaagcctctttcattgaagttaaaagctgccattggccaaagtcacacactctctggagtaatggagtgttagaaagtgagatgataattccaaagaattttgcaggaccagtgtcacagcacaactacagaccaggctatcacacacaaacggcaggaccctggcacctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcaggccattgaaagagaaagaagagaacttggtcaactctttggtcacagccggacatggacagattgacaacttctcactaggagtcttgggaatggcattgttcctggaagaaatgctcaggacccgcgtaggaacgaaacatgcaatattgctagttgcagtttctttcgtgacattgatcacagggaacatgtcttttcgagatttggggagagtgatggtcatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctggctttggggatgatggttctcaaaatagtgagaaacatggaaaagtatcaactagcagtgactatcatggccatcctgtgcgtcccaaatgcagtgatattacaaaacgcatggaaagtgagctgcacaatactggcagtggtgtccgtttccccactgcttttaacatcatcacagcagaaagcagattggataccactggcgttgacgatcaaaggcctcaatccaacagccattttcttaacaaccctctcaagaactagcaagaaaaggagctggccactaaatgaggctattatggcagtcgggatggtgagcattttagctagttccctcttgaagaatgatattcccatgacaggaccattagtagctggagggcttctcactgtgtgttacgtgctcactggaagatcggctgatttggaactggagagagctgctgacgtaagatgggaagaacaggcagagatatcaggaagtagtccaattctgtcaataacaatatcggaagatggtagcatgtcgataaaaaatgaagaagaagaacaaacactgaccatactcattaggacaggactgctggtgatatcaggacttttccctgtgtcaataccaatcacggcagctgcatggtatctgtgggaagtgaaaaaacaacgagctggagtattgtgggatgtcccttcacccccacctgtgggaaaggccgaactggaagatggagcctatagaatcaagcagaaagggattctaggatactcgcagatcggggctggagtttacaaagaaggaacattccacacaatgtggcacgtcacacgcggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacactggaaccataggcgccgtatctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcattgaagacaatccagagattgaagatgacatctttcgaaagaaaagattgaccatcatggacctccacccaggggcgggaaaaacgaagagataccttccagcaatagtcagagaagccataaaacgaggcttgaggacactaatcctggcccccactagagttgtggcggctgaaatggaagaagctctcagaggacttccaataagataccaaacccccgccatcagagctgagcacactgggcgggagattgtggatctaatgtgtcacgccacatttaccatgaggctgctatccccaattagagtaccaaattacaacctaatcatcatggatgaagcccatttcacagacccagcaagcatagcagctagaggatacatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgaatgggtcacggattttaaagggaagactgtttggtttgttccaagcataaaagcaggaaatgatatagcagcttgcctgagaaagaatgggaagaaagtgatacaactcagcaggaagacctttgattctgaatatgtcaagactaggaccaatgattgggactttgtggtcacgacagacatttcagaaatgggcgctaacttcaaggctgagagggttatagaccccaggcgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagtatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaattacgcagacagaagatggtgctttgatggagtcaagaacaatcaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcactagacaacttagcagtcctgcatacggctgaagcaggcggaagggcgtacaatcatgctcttagtgaactgccggagaccctggagacattgcttttactgacactcttggctacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaggcattgcaacccagcaacctgagagcaacatcctggatatagatctacgtcctgcatcagcttggactctatatgctgtggcaacaactttcatcacaccaatgctgagacacagcattgaaaattcctcagtgaatgtgtctctaacggccattgctaaccaagccacagttttaatgggtcttgggaaaggatggccattgtcaaaaatggacatcggagttccccttctcgctatcgggtgctattcacaagttaaccccataactctcacggcggcccttctcttattggtagcacattatgccatcatagggccaggactccaagcgaaagcaactagagaagctcagaaaagagcagcagcgggcattatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgactgggcccatctccacactgtgggaaggaaatccagggagattttggaatacaactattgcagtatcaatggccaacatttttagagggagctacctggccggagccggacttctcttttctatcatgaagaatacggccaacacaagaaggggaactggcaacacaggagagacgcttggagaaaaatggaaaaaccgattgaatgcattggggaagagtgaattccagatctataagaaaagtggaatccaggaggtggatagaaccctagcaaaagaaggcatcaaaagaggagaaacggaccatcacgctgtgtcgcgaggctcggcgaaactgagatggttcgtcgagagaaacctggtcacaccagaagggaaagtaatggacctcggttgcggcagggggggctggtcatactattgtgggggactaaagaatgtaaaagaagtcaaaggcctaacaaaaggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagtggaacccgcaacatcggaattgaaagtgagacaccaaatttggacataattgggaaaagaatagaaaaaataaaacaagagcatgaaacatcatggcactatgaccaagaccacccatacaaaacgtgggcctaccatggcagctacgaaacaaaacagactggatcggcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaattaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagtttggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggatacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcagctgacagccacagaagaaattgcagtgaaaaactggttagcaagagtgggacgtgagaggttatcaagaatggctatcagtggagatgattgtgttgtgaaacccttagatgataggtttgcaagcgctctaacagctctaaatgacatgggaaaaattaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtctctgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacttggtccatacatgccacacatgagtggatgacaacagaagatatgctgacagtctggaacagggtgtggattcaagaaaacccatggatagaagacaaaactccagtagaatcatgggaggaaatcccatatttggggaaaagagaagaccaatggtgcggctcattgatcgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 7155 - RNA, 9876 nt, synthetic construct
  misc_feature 1..9876: note = derived and/or modified CDS sequence (wt) from DENV-2__DQ645555__SS-prME
  source 1..9876: mol_type = other RNA
actgcaggtgtaatcattatgatgattccaacagtggtggcgttccatttaaccacacgcaacggagaaccacacatgatcgtcagtagacaagagaaagggaaaagtcttctgtttaaaacagagaacggtgtgaacatgtgcacccttatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcacaaggggcctggaaacatgctcagagaatcgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgataaaaacggaagccaaacatccagccactttaaggaagtattgtatagaggcaaagctgaccaacacaacaacagcatctcgctgcccaacacaaggagaacccagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaggtaacaccacagagttccattacagaagcagaactgacaggttatggcaccgtcacgatggaatgctctccgagaacgggcctcgactttaatgagatggtgttgctgcaaatggaagacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgcctttagcggggtttcatggactatgaaaatcctcataggagttgtcatcacatggataggaatgaattcacgcagcacctcactgtctgtgtcactagtattagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggtaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcacttaatgacacatggaagattgagaaagcctctttcattgaagttaaaagctgccattggccaaagtcacacactctctggagtaatggagtgctagaaagtgagatgataattccaaagaattttgcaggaccagtgtcacagcacaactacagaccaggctatcacacacaaacggcaggaccctggcacctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcaggccattgaaagagaaagaagagaacttggtcaactctttggtcacagccggacatggacagattgacaacttctcactaggagtcttgggaatggcattgttcctggaagaaatgctcaggacccgcgtaggaacgaaacatgcaatattgctagttgcagtttctttcgtgacattgatcacagggaacatgtcttttcgagatttggggagagtgatggtcatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctggctttggggatgatggttctcaaaatagtgagaaacatggaaaagtatcaactagcagtgactatcatggccatcttgtgcgtcccaaatgcagtgatattacaaaacgcatggaaagtgagctgcacaatactggcagtggtgtccgtttccccactgcttttaacatcatcacagcagaaagcagattggataccactggcgttgacgatcaaaggcctcaatccaacagccattttcttaacaaccctctcaagaactagcaagaaaaggagctggccactgaatgaggctattatggcagtcgggatggtgagcattttagctagttccctcttgaagaatgatattcccatgacaggaccattagtagctggagggcttctcactgtgtgttacgtgctcactggaagatcggctgatttggaactggagagagctgctgacgtaagatgggaagaacaggcagagatatcaggaagtagtccaattctgtcaataacaatatcggaagatggtagcatgtcgataaaaaatgaagaagaagaacaaacactgaccatactcattaggacaggactgctggtgatatcaggacttttccctgtgtcaataccaatcacggcagctgcatggtatctgtgggaagtgaaaaaacaacgagctggagtattgtgggatgtcccttcacccccacctgtgggaaaggccgaactggaagatggagcctatagaatcaagcagaaagggattctaggatactcgcagatcggggctggagtttacaaagaaggaacattccacacaatgtggcacgtcacacgcggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacactggaaccataggcgccgtatctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcattgaagacaatccagagattgaagatgacatctttcgaaagaaaagattgaccatcatggacctccacccaggggcgggaaaaacgaagagataccttccagcaatagtcagagaagccataaaacgaggcttgaggacactaatcctggcccccactagagttgtggcggctgaaatggaagaagctctcagaggacttccaataagataccaaacccccgccatcagagctgagcacactgggcgggagattgtggatctaatgtgtcacgccacatttaccatgaggctgctatccccaattagagtaccaaattacaacctaatcatcatggatgaagcccatttcacagacccagcaagcatagcagctagaggatacatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgaatgggtcacggattttaaagggaagactgtttggtttgttccaagcataaaagcaggaaatgatatagcagcttgcctgagaaagaatgggaagaaagtgatacaactcagcaggaagacctttgattctgaatatgtcaagactaggaccaatgattgggactttgtggtcacgacagacatttcagaaatgggcgctaacttcaaggctgagagggttatagaccccaggcgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagtatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaattacgcagacagaagatggtgctttgatggagtcaagaacaatcaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcactagacaacttagcagtcctgcatacggctgaagcaggcggaagggcgtacaatcatgctcttagtgaactgccggagaccctggagacattgcttttactgacactcttggctacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaggcattgcaacccagcaacctgagagcaacatcctggacatagatctacgtcctgcatcagcttggactctatatgctgtggcaacaactttcatcacaccaatgctgagacacagcattgaaaattcctcagtgaatgtgtctctaacggccattgctaaccaagccacagttttaatgggtcttgggaaaggatggccattgtcaaaaatggacatcggagttccccttctcgctatcgggtgctattcacaagttaaccccataactctcacggcggcccttctcttattggtagcacattatgccatcatagggccaggactccaagcgaaagcaactagagaagctcagaaaagagcagcagcgggcattatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgactgggcccatctccacactgtgggaaggaaatccagggagattttggaatacaactattgcagtatcaatggctaacatttttagagggagctacctggccggagccggacttctcttttctatcatgaagaatacggccaacacaagaaggggaactggcaacacaggagagacgcttggagaaaaatggaaaaaccgattgaatgcattggggaagagtgaattccagatctataagaaaagtggaatccaggaggtggatagaaccctagcaaaagaaggcatcaaaagaggagaaacggaccatcacgctgtgtcgcgaggctcggcgaaactgagatggttcgtcgagagaaacctggtcacaccagaagggaaagtaatggacctcggttgcggcagggggggctggtcatactattgtgggggactaaagaatgtaaaagaagtcaaaggcctaacaaaaggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagtggaacccgcaacatcggaattgaaagtgagacaccaaatttggacataattgggaaaagaatagaaaaaataaaacaagagcatgaaacatcatggcactatgaccaagaccacccatacaaaacgtgggcctaccatggcagctacgaaacaaaacagactggatcggcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaattaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagtttggcaaagcaaaaggcagcagagccatatggtacatgtggcttggagcacgcttcttagagtttgaagccttaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggatacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcagctgacagccacagaagaaattgcagtgaaaaactggttagcaagagtgggacgtgagaggttatcaagaatggctatcagtggagatgattgtgttgtgaaacccttagatgataggtttgcaagcgctttaacagctctaaatgacatgggaaaagttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtctctgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacttggtccatacatgccacacatgagtggatgacaacagaagatatgctgacagtctggaacagggtgtggattcaagaaaacccatggatagaagacaaaactccagtagaatcatgggaggaaatcccatatttggggaaaagagaagaccaatggtgcggctcattgatcgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 7156 - RNA, 9876 nt, synthetic construct
  misc_feature 1..9876: note = derived and/or modified CDS sequence (wt) from DENV-2__DQ645556__SS-prME
  source 1..9876: mol_type = other RNA
actgcaggtgtaatcattatgatgattccaacagtggtggcgttccatttaaccacacgcaacggagaaccacacatgatcgtcagtagacaagagaaagggaaaagtcttctgtttaaaacagagaacggtgtgaacatgtgcacccttatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgctcagagaatcgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgataaaaacggaagccaaacatccagccactttaaggaagtattgtatagaggcaaagctgaccaacacaacaacagcatctcgctgcccaacacaaggagaacccagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaggtaacaccacagagttccattacagaagcagaactgacaggttatggcaccgtcacgatggaatgctctccgagaacgggcctcgactttaatgagatggtgttgctgcaaatggaagacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgcctttagcggggtttcatggactatgaaaatcctcataggagttgtcatcacatggataggaatgaattcacgcagcacctcactgtctgtgtcactagtattagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggtaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcacttaatgacacatggaagattgagaaagcctctttcattgaagttaaaagctgccattggccaaagtcacacactctctggagtaatggagtgctagaaagtgagatgataattccaaagaattttgcaggaccagtgtcacagcacaactacagaccaggctatcacacacaaacggcaggaccctggcacctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcaggccattgaaagagaaagaagagaacttggtcaactctttggtcacagccggacatggacagattgacaacttctcactaggagtcttgggaatggcattgttcctggaagaaatgctcaggacccgcgtaggaacgaaacatgcaatattgctagttgcagtttctttcgtgacattgatcacagggaacatgtcttttcgagatttggggagagtgatggtcatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctggctttggggatgatggttctcaaaatagtgagaaacatggaaaagtatcaactagcagtgactatcatggccatcttgtgcgtcccaaatgcagtgatattacaaaacgcatggaaagtgagctgcacaatactggcagtggtgtccgtttccccactgcttttaacatcatcacagcagaaagcagattggataccactggcgttgacgatcaaaggcctcaatccaacagccattttcttaacaaccctctcaagaactagcaagaaaaggagctggccactaaatgaggctattatggcagtcgggatggtgagcattttagctagttccctcttgaagaatgatattcccatgacaggaccattagtagctggagggcttctcactgtgtgttacgtgctcactggaagatcggctgatttggaactggagagagctgctgacgtaagatgggaagaacaggcagagatatcaggaagtagtccaattctgtcaataacaatatcggaagatggtagcatgtcgataaaaaatgaagaagaagaacaaacactgaccatactcattaggacaggactgctggtgatatcaggacttttccctgtgtcaataccaatcacggcagctgcatggtatctgtgggaagtgaaaaaacaacgagctggagtattgtgggatgtcccttcacccccacctgtgggaaaggccgaactggaagatggagcctatagaatcaagcagaaagggattctaggatactcgcagatcggggctggagtttacaaagaaggaacattccacacaatgtggcacgtcacacgcggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacactggaaccataggcgccgtatctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcattgaagacaatccagagattgaagatgacatctttcgaaagaaaagattgaccatcatggacctccacccaggggcgggaaaaacgaagagataccttccagcaatagtcagagaagccataaaacgaggcttgaggacactaatcctggcccccactagagttgtggcggctgaaatggaagaagctctcagaggacttccaataagataccaaacccccgccatcagagctgagcacactgggcgggagattgtggatctaatgtgtcacgccacatttaccatgaggctgctatccccaattagagtaccaaattacaacctaatcatcatggatgaagcccatttcacagacccagcaagcatagcagctagaggatacatttcaactagagttgagatgggtgaagcagctgggattttcatgacagctactcctcctggaagcagagacccatttcctcagagcaatgcaccaatcatggatgaagaaagggaaatccctgagcgttcgtggaattctggacatgaatgggtcacggattttaaagggaagactgtttggtttgttccaagcataaaagcaggaaatgatatagcagcttgcctgagaaagaatgggaagaaagtgatacaactcagcaggaagacctttgattctgaatatgtcaagactaggaccaatgattgggactttgtggtcacgacagacatttcagaaatgggcgctaacttcaaggctgagagggttatagaccccaggcgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagtatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaattacgcagacagaagatggtgctttgatggagtcaagaacaatcaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcactagacaacttagcagtcctgcatacggctgaagcaggcggaagggcgtacaatcatgctcttagtgaactgccggagaccctggagacattgcttttactgacactcttggctacagtcacgggcggaatcttcctattcttgatgagcggaaaaggcatagggaagatgaccttgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaggcattgcaacccagcaacctgagagcaacatcctggatatagatctacgtcctgcatcagcttggactctatatgctgtggcaacaactttcatcacaccaatgctgagacacagcattgaaaattcctcagtgaatgtgtctctaacggccattgctaaccaagccacagttttaatgggtcttgggaaaggatggccattgtcaaaaatggacatcggagttccccttctcgctatcgggtgctattcacaagttaaccccataactctcacggcggcccttctcttattggtagcacattatgccatcatagggccaggactccaagcgaaagcaactagagaagctcagaaaagagcagcagcgggcattatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgactgggcccatctccacactgtgggaaggaaatccagggagattttggaatacaactattgcagtatcaatggccaacatttttagagggagctacctggccggagccggacttctcttttctatcatgaagaatacggccaacacaagaaggggaactggcaacacaggagagacgcttggagaaaaatggaaaaaccgattgaatgcattggggaagagtgaattccagatctataagaaaagtggaatccaggaggtggatagaaccctagcaaaagaaggcatcaaaagaggagaaacggaccatcacgctgtgtcgcgaggctcggcgaaactgagatggttcgtcgagagaaacctggtcacaccagaagggaaagtaatggacctcggttgcggcagagggggctggtcatactattgtgggggactaaagaatgtaaaagaagtcaaaggcctaacaaaaggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagtggaacccgcaacatcggaattgaaagtgagacaccaaatttggacataattgggaaaagaatagaaaaaataaaacaagagcatgaaacatcatggcactatgaccaagaccacccatacaaaacgtgggcctaccatggcagctacgaaacaaaacagactggatcggcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaattaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagtttggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggatacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacagtaatggacattatatcgagaagagaccaaagaggtagcggacaagttgtcacctacggcctcaatactttcaccaacatggaagcccaactgatcagacagatggagggagaaggagtcttcaaaaacatccagcagctgacagccacagaagaaattgcagtgaaaaactggttagcaagagtgggacgtgagaggttatcaagaatggctatcagtggagatgattgtgttgtgaaacccttagatgataggtttgcaagcgctctaacagctctaaatgacatgggaaaagttaggaaagacgtacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtctctgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacttggtccatacatgccacacatgagtggatgacaacagaagatatgctgacagtctggaacagggtgtggattcaagaaaacccatggatagaagacaaaactccagtagaatcatgggaggaaatcccatatttggggaaaagagaagaccaatggtgcggctcattgatcgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 7157 - RNA, 9876 nt, synthetic construct
  misc_feature 1..9876: note = derived and/or modified CDS sequence (wt) from DENV-2__AF204178__SS-prME
  source 1..9876: mol_type = other RNA
actgcaggcatgatcattatgctgattccaacagtgatggcgttccatttaaccacacgtaacggagaaccacacatgatcgtcagcagacaagagaaagggaaaagtcttctgtttaaaacaggggatggtgtgaacatgtgtaccctcatggccatggaccctggtgaattgtgtgaagatacaatcacgtacaagtgtcctcttctcaagcagaatgaaccagaagacatagattggtggtgcaactctacgtccacatgggtaacttatgggacgtgtaccactacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccatgatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacagaagccaaacaacctgccactctaaggaagtactgtatagaggcaaagctgaccaacacaacaacagattctcgctgcccaacacaaggagaacccagcctaaatgaagagcaggacaaaaggttcgtctgcaaacactccatggtggacagaggatggggaaatggatgtggattatttggaaaaggaggcattgtgacctttgctatgttcacatgcaaaaagaacatgaaaggaaaagtcgtgcaaccagaaaacttggaatacaccattgtgataacacctcactcaggggaagagcatgcagtcggaaatgacacaggaaaacatggcaaggaaatcaaaataacaccacagagttccatcacagaagcagagttgacaggctatggcactgtcacgatgaagtgctctccgagaacgggcctcgacttcaatgagatggtgttgctgcaaatggaaaataaagcttggctggtgcacaggcaatggttcctagacctgccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggaaacttactgttcacaggacatctcaagtgcaggctgaggatggacaaactacagctcaaaggaatgtcatactctatgtgcacaggaaagtttaaagttgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacagaaaaagatagcccagtcaacatagaagcagaacctccattcggagacagctacatcatcataggagtagagccgggacaattgaagctcaactggtttaagaaaggaagttctatcggccaaatgtttgagacaacaatgaggggagcgaagagaatggccattttaggtgacacagcttgggattttggatccctgggaggagtgtttacatctataggaaaggctctccaccaagttttcggagcaatctatggggctgccttcagtggggtctcatggactatgaaaatcctcataggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaagtgtggcagtgggattttcatcacagacgacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcggccccagcccactgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaaaagcaggatgtattctgcgactcaaaactcatgtcagcggtcataaaagacaacagagccgcccatgccgatatgggttattggatagaaagtgcactcaatgacacatggaagatagagaaagcctctttcatcgaagttaaaagctgccactggccaaagtcacacaccctctggagtaatggagtgctagaaagtgagatgataattccaaagaatttcgctggaccagtgtcacaacacaactacagaccaggctaccatacacaaacagcaggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaggtcagaccaacttttgcagctggactactcttgagaaagttgacctccaaggaattgatgatgactaccataggaatcgtactcctctcccagagcaccataccagagaccattcttgaactgactgatgcgttagccttgggcatgatggtccttaaaatggtgagaaaaatggaaaagtatcaattggcagtgactatcatggctatcttgtgcgtcccaaatgcagtgatattacaaaacgcatggaaagtgagttgcacaatattggcagtggtgtccgtttccccactgttcataacatcctcacagcagaaagcggattggataccattagcattgacgatcaagggtctcaatccaacagctatttttctaacaaccctttcaagaaccaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaatactgaccatactcattagaacaggattgctggtgatctcaggactttttcctgtatcaataccaatcacggcagcagcatggtacctgtgggaagtgaagaaacaacgggctggagtattgtgggatgtcccttcacccccacccgtgggaaaggctgaactggaagatggagcctatagaatcaagcaaaaagggattcttggatattcccagatcggagccggagtttacaaagaaggaacattccatacaatgtggcatgtcacacgcggcgctgttctaatgcataaaggaaagaggattgaaccatcatgggcggacgttaagaaagacctaatatcatatggaggaggctggaagctagaaggagaatggaaggaaggagaagaagtccaggtcttggcattggagcctggaaaaaatccaagagccgtccaaacaaaacctggtcttttcaaaaccaacgccggaaccataggtgccgtatctctggacttttctcctggaacctcaggatctccaatcatcgacaaaaaaggaaaagttgtgggtctttatggtaatggtgttgttacaaggagtggagcatatgtgagtgctatagcccagactgaaaaaagtattgaagacaatccagagatcgaagatgacatttttcgaaagagaaaattgaccatcatggacctccacccaggagcgggaaagacgaagagataccttccggccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataaaagcaggaaatgatatagcagcttgcctgagaaaaaatggaaagaaagtgatacaactcagtaggaagacctttgattctgagtatgtcaagactagaaccaatgattgggacttcgtggtcacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagctgaaggcatcaactacgcagacagaaggtggtgttttgatggaattaagaacaaccaaatcttggaagaaaatgtggaggtggaaatctggacaaaagaaggggaaaggaaaaaattaaaacccagatggttggatgccaagatctactctgacccactggcgctaaaggaattcaaggagtttgcagctggaagaaagtccctgaccctgaacctaatcacagaaatgggtaggcttccaactttcatgactcagaaggcaagagacgcactggacaacttagcagtgctgcacacggctgaagcaggtggaagggcgtacaatcatgctctcagtgaactgccggagaccctggagacattgctcttactgacacttctggctacagtcacgggaggaatctttttattcttgatgagcggaaggggtatagggaagatgaccctgggaatgtgctgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcattacaacccagcaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaggcaaccagagaagctcagaaaagagcagcagcgggcatcatgaaaaacccaactgtcgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacatttttagagggagttacttggccggagctggacttctcttttccatcatgaagaacacaaccaacacgagaaggggaactggcaacataggagagacgcttggagagaaatggaaaatccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctaacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccctcagtcatagaaaaaatggaaacactacaaaggaaatatggaggagccttagtggggaatccactctcacgaaactccacacatgagatgtactgggtatccaatgcctccgggaacatagtgtcatcagtgaacatgatttcaaggatgttgatcaacagattcacaatgagacacaagaaagccacttacgagccagatgtagacctcggaagcggaacccgcaacatcggaattgaaagtgagataccaaacctagacataatcgggaaaagaatagaaaaaataaaacaagagcatgaaacatcatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtgacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtataacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccttgagtggagtggaaggagaagggctgtacaagctaggttacattttaagagacgtgagcaagaaagagggaggagcaatgtatgccgatgacaccgcaggatgggacacaagaatcacactagaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagtcttcaaaagcattcagcacctgacagtcacagaagaaatcgccgtgcaaaactggttagcaagagtacggcgcgaaaggttatcaagaatggctatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtacttgtagttccatgcagaaaccaagatgaactgattggtagagcccgaatttcccaaggagctgggtggtctttgcgagagacggcctgtttggggaagtcctacgcccaaatgtggagcttgatgtacttccacagacgtgacctcagactggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 7158 - RNA, 9876 nt, synthetic construct
  misc_feature 1..9876: note = derived and/or modified CDS sequence (wt) from DENV-2__AF204177__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctgtttaaaacaggggatggtgtgaacatgtgtaccctcatggccatggaccttggtgaattgtgtgaagatacaatcacgtacaagtgtcctcttctcaggcagaatgaaccagaagacatagattgttggtgcaactctacgtccacatgggtaacttatgggacgtgtaccaccacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccataatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggatcttgaactgataaaaacagaagccaaacaatctgccactctaaggaagtactgtatagaggcaaagttgaccaacacaacaacagaatctcgctgcccaacacaaggagaacccagcctaaatgaagagcaggacaaaaggttcgtctgcaaacactccatggtggacagaggatggggaaatggatgtggattatttggaaaaggaggcattgtgacctgtgctatgttcacatgcaaaaagaacatgaaaggaaaagtcgtgcaaccagaaaacttggaatacaccattgtgataacacctcactcaggggaagagcatgcagtcggaaatgacacaggaaaacatggcaaggaaatcaaaataacaccacagagttccatcacagaagcagagttgacaggctatggcactgtcacgatggagtgctctccgagaacgggcctcgacttcaatgaaatggtgttgctgcaaatggaaaataaagcttggctggtgcacaggcaatggttcctagacctgccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggaaacttactgttcacaggacatctcaagtgcaggctgaggatggacaaactacagctcaaaggaatgtcatactctatgtgcacaggaaagtttaaagttgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacagaaaaagatagcccagtcaacatagaagcagaacctccattcggagacagctacatcatcataggagtagagccgggacaattgaagctcaactggtttaagaaaggaagttctatcggccaaatgtttgagacaacaatgaggggagcgaagagaatggccattttaggtgacacagcttgggattttggatccctgggaggagtgtttacatctataggaaaggctctccaccaagttttcggagcaatctatggggctgccttcagtggggtctcatggactatgaaaatcctcataggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaagtgtggcagtgggattttcatcacagacaacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcggccccagcccactgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaaaagcaggatgtattctgcgactcaaaactcatgtcagcggccataaaagacaacagagccgtccatgccgatatgggttattggatagaaagtgcactcaatgacacatggaagatagagaaagcctccttcatcgaagttaaaagctgccactggccaaagtcacacaccctctggagtaatgaagtgctagaaagtgagatgataattccaaagaatttcgctggaccagtgtcacaacacaactacagaccaggctaccatacacaaacagcaggaccatggcatctaggtaagcttgagatggactttgatttctgcgaaggaaccacagtggtggtgactgaggactgtggaaatagaggaccctctttaagaacaactactgcctctggaaaactcataacagaatgttgctgccgatcctgcacattaccaccgctaagatacagaggtgaggacggatgctggtacgggatggaaatcagaccattgaaagagaaagaagagaacttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccatagggatcgtactcctctcccagagcaccataccagagaccattcttgaactgactgatgcgttagccttgggcatgatggtccttaaaatggtgagaaaaatggaaaagtatcaattggcagtgactatcatggctatcttgtgcgtcccaaatgcagtgatattacaaaacgcatggaaagtgagttgcacaatattggcagtggtgtccgtttccccactgttcttaacatcctcacagcagaaagcggattggataccattagcattgacgatcaagggtctcaatccaacagctatttttctaacaaccctttcaaaaaccaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaatactgaccatactcattagaacaggattgctggtgatctcaggactttttcctgtatcaataccaatcacggcagcagcatggtacctgtgggaagtgaagaaacaacgggctggagtattgtgggatgtcccttcacccccaccggtgggaaaggctgaactggaagatggagcctatagaatcaagcaaaaagggattcttggatattcccagatcggagccggagtttacaaagaaggaacattccatacaatgtggcatgtcacacgcggcgctgttctaatgcataaaggaaagaggattgaaccatcatgggcggacgttaagaaagacctaatatcatatgcaggaggctggaagctagaaggagaatggaaggaaggagaagaagtccaggtcttggcactggagcctggaaaaaatccaagagccgtccaaacaaaacctggtcttttcaaaaccaacgccggaaccataggtgccgtatctctggacttttctcctggaacctcaggatctccaatcatcgacaaaaaaggaaaagttgtgggtctttatggtaatggtgttgttacaaggagtggagcatatgtgagtgctatagcccagactgaaaaaagtattgaagacaatccagagatcgaagatgacatttttcgaaaaagaaaattgaccatcatggacctccacccaggagcgggaaagacgaagagataccttccggccatagtcagagaggctataaaacggggcctgaggacattgatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataaaagcaggaaatgatatagcagcttgcctgagaaaaaatggaaagaaagtgatacaactcagtaggaagacctttgattctgagtatgtcaagactagaaccaatgattgggacttcgtggtcacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctggataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggctggcctacagagtggcagctgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaggatctactctgacccactggcgctaaaggaattcaaggagtttgcagctggaagaaagtccctgaccctgaacctaatcacagaaatgggtaggcttccaactttcatgactcagaaggcaagagacgcactggacaacttagcagtgctgcacacggctgaagcaggtggaagggcgtacaatcatgctctcagtgaactgccggagaccctggagacattgcttttactgacacttctggctacagtcacgggaggaatctttttattcttgatgagcggaaggggtatagggaagatgaccctgggaatgtgctgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcattacaacccaacaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaagcaaccagagaagctcagaaaagagcagcagcgggcatcatgaaaaacccaactgtcgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacatttttagagggagttacttggccggagctggacttctcttttccatcatgaagaacacaaccaacacgagaaggggaactggcaacataggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctaacaaaaagaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccctcagtcatagaaaaaatggaagcactacaaaggaaatatggaggagccttagtgaggaatccactttcacgaaactccacacatgagatgtactgggtatccaatgcctccgggaacatagtgtcatcagtgaacatgatttcaaggatgttgatcaacagattcacaatgagacacaagaaagccacttacgagccagatgtagacctcggaagcggaacccgcaacatcggaattgaaagtgagataccaaacctagacataatcgggaaaagaatagaaaaaataaaacaagagcatgaaacattatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtgacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagcggaagtcggcacgtgaggctgttgaagatagtaggttttgggagctggttgacaaggaaaggaatctccatcttgaaggaaagtgtgaaacatgtgtgtataacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccttgagtggagtggaaggagaagggctgcacaagctaggttacattttaagagacgtgagcaagaaagagggaggagcaatgtatgccgatgacaccgcaggatgggacacaagaatcacactagaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagttttcaaaagcattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccctcaagaggatggaacgattggacacaagtgcccttctgttcacaccatttccatgagttaatcatgaaagacggccgcgtacttgtagttccatgcagaaaccaaaatgaactgattggtagagcccgaatttcccaaggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaacttcagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 7159 - RNA, 9876 nt, synthetic construct
  misc_feature 1..9876: note = derived and/or modified CDS sequence (wt) from DENV-2__DQ645540__SS-prME
  source 1..9876: mol_type = other RNA
actgcaggtgtaatcattatgatgattccaacagtggtggcgttccatttaaccacacgcaacggagaaccacacatgatcgtcagtagacaagagaaagggaaaagtcttctgtttaaaacagagaacggtgtgaacatgtgcacccttatggccatggaccttggtgaattgtgtgaagacacaattacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgctcagagaatcgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgacaaaaacggaagccaaacatccagccactttaaggaagtattgtatagaggcaaagctgaccaacacaacaacagcatctcgctgcccaacacaaggagaacccagcctaaatgaagaacaggacaaaaggtttgtctgcaaacactccatggttgacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaggtaacaccacagagttccattacagaagcagaactgacaggttatggcaccgtcacgatggaatgctctccgagaacgggcctcgactttaatgagatggtgttgctgcaaatggaagacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagttacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgcctttagcggggtttcatggactatgaaaatcctcataggagttgtcatcacatggataggaatgaattcacgcagcacctcactgtctgtgtcactagtattagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggtaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcacttaatgacacatggaagattgagaaagcctctttcattgaagttaaaagctgccattggccaaagtcacacactctctggagtaatggagtgctagaaagtgagatgataattccaaagaattttgcaggaccagtgtcacagcacaactacagaccaggctatcatacacaaacggcaggaccctggcacctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcaggccattgaaagagaaagaagagaacttggtcaactctttggtcacagccggacatggacagattgacaacttctcactaggagtcttgggaatggcattgttcctggaagaaatgctcaggacccgcgtaggaacgaaacatgcaatattgctagttgcagtttctttcgtgacattgatcacagggaacatgtcttttcgagatttggggagagtgatggtcatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctggctttggggatgatggttctcaaaatagtgagaaacatggaaaagtatcaactagcagtgactatcatggccatcttgtgcgtcccaaatgcagtgatattacaaaacgcatggaaagtgagctgcacaatactggcagtggtgtccgtttccccactgcttttaacatcatcacagcagaaagcagattggataccactggcgttgacgatcaaaggcctcaatccaacagccattttcttaacaaccctctcaagaactagcaagaaaaggagctggccactaaatgaggctattatggcagtcgggatggtgagcattttagctagttccctcttgaagaatgatattcccatgacaggaccattagtagctggagggcttctcactgtgtgttacgtgctcactggaagatcggctgatttggaactggagagagctgctgacgtaagatgggaagaacaggcagagatatcaggaagtagtccaattctgtcaataacaatatcggaagatggtagcatgtcgataaaaaatgaagaagaagaacaaacactgaccatactcattaggacaggactgctggtgatatcaggacttttccctgtgtcaataccaatcacggcagctgcatggtatctgtgggaagtgaaaaaacaacgagctggagtattgtgggatgtcccttcacccccacctgtgggaaaggccgaactggaagatggagcctatagaatcaagcagaaagggattctaggatactcgcagatcggggctggagtttacaaagaaggaacattccacacaatgtggcacgtcacacgcggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacactggaaccataggcgccgtatctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcattgaagacaatccagagattgaagatgacatctttcgaaagaaaagattgaccatcatggacctccacccaggggcgggaaaaacgaagagataccttccagcaatagtcagagaagccataaaacgaggcttgaggacactaatcctggcccccactagagttgtggcggctgaaatggaagaagctctcagaggacttccaataagataccaaacccccgccatcagagctgagcacactgggcgggagattgtggatctaatgtgtcacgccacatttaccatgaggctgctatccccaattagagtaccaaattacaacctaatcatcatggatgaagcccatttcacagacccagcaagcatagcagctagaggatacatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgaatgggtcacggattttaaagggaagactgtttggtttgttccaagcataaaagcaggaaatgatatagcagcttgcctgagaaagaatgggaagaaagtgatacaactcagcaggaagacctttgattctgaatatgtcaagactaggaccaatgattgggactttgtggtcacgacagacatttcagaaatgggcgctaacttcaaggctgagagggttatagaccccaggcgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagtatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaattacgcagacagaagatggtgctttgatggagtcaagaacaatcaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcactagacaacttagcagtcctgcatacggctgaagcaggcggaagggcgtacaatcatgctcttagtgaactgccggagaccctggagacattgcttttactgacactcttggccacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaggcattgcaacccagcaacctgagagcaacatcctggacatagatctacgtcctgcatcagcttggactctatatgctgtggcaacaactttcatcacaccaatgctgagacacagcattgaaaattcctcagtgaatgtgtctctaacggccattgctaaccaagccacagttttaatgggtcttgggaaaggatggccattgtcaaaaatggacatcggagttccccttctcgctatcgggtgctattcacaagttaaccccataactctcacggcggcccttctcttattggtagcacattatgccatcatagggccaggactccaagcgaaagcaactagagaagctcagaaaagagcagcagcgggcattatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgactgggcccatctccacactgtgggaaggaaatccagggagattttggaatacaactattgcagtatcaatggctaacatttttagagggagctacctggccggagccggacttctcttttctatcatgaagaatacggccaacacaagaaggggaactggcaacacaggagagacgcttggagaaaaatggaaaaaccgattgaatgcattggggaagagtgaattccagatctataagaaaagtggaatccaggaggtggatagaaccctagcaaaagaaggcatcaaaagaggagaaacggaccatcacgctgtgtcgcgaggctcggcgaaactgagatggttcgtcgagagaaacctggtcacaccagaagggaaagtaatggacctcggttgcggcagggggggctggtcatactattgtgggggactaaagaatgtaaaagaagtcaaaggcctaacaaaaggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagcggaacccgcaacatcggaattgaaagtgagataccaaatttggacataattgggaaaagaatagaaaaaataaaacaagagcatgaaacatcatggcactatgaccaagaccacccatacaaaacgtgggcctaccatggcagctacgaaacaaaacagactggatcggcatcatccatggtgaacggagtggttaggctgctaacaaaaccttgggacgtcatccctatggtgacacagatggcaatgacagacacgactccatttggacaacagcgcgttttcaaagtgaaagtggacacgagaacccaagaacctaaagaaggcactaaaaaactaatgaaaatcacggcagaatggctctggaaagaattaggaaagaaaaagacacctaggatgtgcaccagagaagaattcacaagaaaggtgaggagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagtttggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcagctgacagccacagaagaaattgcagtgaaaaactggttagcaagagtgggacgtgagaggttatcaagaatggctatcagtggagatgattgtgttgtgaaacccttagatgataggtttgcaagcgctctaacagctctaaatgacatgggaaaagttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtctctgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacttggtccatacatgccacacatgagtggatgacaacagaagatatgctgacagtctggaacagggtgtggattcaagaaaacccatggatagaagacaaaactccagtagaatcatgggaggaaatcccatatttggggaaaagagaagaccaatggtgcggctcattgatcgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 7160 - RNA, 9876 nt, synthetic construct
  misc_feature 1..9876: note = derived and/or modified CDS sequence (wt) from DENV-2__DQ645541__SS-prME
  source 1..9876: mol_type = other RNA
actgcaggtgtaatcattatgatgattccaacagtggtggcgttccatttaaccacacgcaacggagaaccacacatgatcgtcagtagacaagagaaagggaaaagtcttctgtttaaaacagagaacggtgtgaacatgtgcacccttatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgctcagagaatcgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgacaaaaacggaagccaaacatccagccactttaaggaagtattgtatagaggcaaagctgaccaacacaacaacagcatctcgctgcccaacacaaggagaacccagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaggtaacaccacagagttccattacagaagcagaactgacaggttatggcaccgtcacgatggaatgctctccgagaacgggcctcgactttaatgagatggtgttgctgcaaatggaagacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagttacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgcctttagcggggtttcatggactatgaaaatcctcataggagttgtcatcacatggataggaatgaattcacgcagcacctcactgtctgtgtcactagtattagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggtaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcacttaatgacacatggaagattgagaaagcctctttcattgaagttaaaagctgccattggccaaagtcacacactctctggagtaatggagtgctagaaagtgagatgataattccaaagaattttgcaggaccagtgtcacagcacaactacagaccaggctatcatacacaaacggcaggaccctggcacctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcaggccattgaaagagaaagaagagaacttggtcaactctttggtcacagccggacatggacagattgacaacttctcactaggagtcttgggaatggcattgttcctggaagaaatgctcaggacccgcgtaggaacgaaacatgcaatattgctagttgcagtttctttcgtgacattgatcacagggaacatgtcttttcgagatttggggagagtgatggtcatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctggctttggggatgatggttctcaaaatagtgagaaacatggaaaagtatcaactagcagtgactatcatggccatcttgtgcgtcccaaatgcagtgatattacaaaacgcatggaaagtgagctgcacaatactggcagtggtgtccgtttccccactgcttttaacatcatcacagcagaaagcagattggataccactggcgttgacgatcaaaggcctcaatccaacagccattttcttaacaaccctctcaagaactagcaagaaaaggagctggccactaaatgaggctattatggcagtcgggatggtgagcattttagctagttccctcttgaagaatgatattcccatgacaggaccattagtagctggagggcttctcactgtgtgttacgtgctcactggaagatcggctgatttggaactggagagagctgctgacgtaagatgggaagaacaggcagagatatcaggaagtagtccaattctgtcaataacaatatcggaagatggtagcatgtcgataaaaaatgaagaagaagaacaaacactgaccatactcattaggacaggactgctggtgatatcaggacttttccctgtgtcaataccaatcacggcagctgcatggtatctgtgggaagtgaaaaaacaacgagctggagtattgtgggatgtcccttcacccccacctgtgggaaaggccgaactggaagatggagcctatagaatcaagcagaaagggattctaggatactcgcagatcggggctggagtttacaaagaaggaacattccacacaatgtggcacgtcacacgcggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacactggaaccataggcgccgtatctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcattgaagacaatccagagattgaagatgacatctttcgaaagaaaagattgaccatcatggacctccacccaggggcgggaaaaacgaagagataccttccagcaatagtcagagaagccataaaacgaggcttgaggacactaatcctggcccccactagagttgtggcggctgaaatggaagaagctctcagaggacttccaataagataccaaacccccgccatcagagctgagcacactgggcgggagattgtggatctaatgtgtcacgccacatttaccatgaggctgctatccccaattagagtaccaaattacaacctaatcatcatggatgaagcccatttcacagacccagcaagcatagcagctagaggatacatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgaatgggtcacggattttaaagggaagactgtttggtttgttccaagcataaaagcaggaaatgatatagcagcttgcctgagaaagaatgggaagaaagtgatacaactcagcaggaagacctttgattctgaatatgtcaagactaggaccaatgattgggactttgtggtcacgacagacatttcagaaatgggcgctaacttcaaggctgagagggttatagaccccaggcgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagtatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaattacgcagacagaagatggtgctttgatggagtcaagaacaatcaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcactagacaacttagcagtcctgcatacggctgaagcaggcggaagggcgtacaatcatgctcttagtgaactgccggagaccctggagacattgcttttactgacactcttggccacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaggcattgcaacccagcaacctgagagcaacatcctggacatagatctacgtcctgcatcagcttggactctatatgctgtggcaacaactttcatcacaccaatgctgagacacagcattgaaaattcctcagtgaatgtgtctctaacggccattgctaaccaagccacagttttaatgggtcttgggaaaggatggccattgtcaaaaatggacatcggagttccccttctcgctatcgggtgctattcacaagttaaccccataactctcacggcggcccttctcttattggtagcacattatgccatcatagggccaggactccaagcgaaagcaactagagaagctcagaaaagagcagcagcgggcattatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgactgggcccatctccacactgtgggaaggaaatccagggagattttggaatacaactattgcagtatcaatggctaacatttttagagggagctacctggccggagccggacttctcttttctatcatgaagaatacggccaacacaagaaggggaactggcaacacaggagagacgcttggagaaaaatggaaaaaccgattgaatgcattggggaagagtgaattccagatctataagaaaagtggaatccaggaggtggatagaaccctagcaaaagaaggcatcaaaagaggagaaacggaccatcacgctgtgtcgcgaggctcggcgaaactgagatggttcgtcgagagaaacctggtcacaccagaagggaaagtaatggacctcggttgcggcagggggggctggtcatactattgtgggggactaaagaatgtaaaagaagtcaaaggcctaacaaaaggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagtggaacccgcaacatcggaattgaaagtgagacaccaaatttggacataattgggaaaagaatagaaaaaataaaacaagagcatgaaacatcatggcactatgaccaagaccacccatacaaaacgtgggcctaccatggcagctacgaaacaaaacagactggatcggcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaattaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagtttggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcagctgacagccacagaagaaattgcagtgaaaaactggttagcaagagtgggacgtgagaggttatcaagaatggctatcagtggagatgattgtgttgtgaaacccttagatgataggtttgcaagcgctctaacagctctaaatgacatgggaaaagttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtctctgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacttggtccatacatgccacacatgagtggatgacaacagaagatatgctgacagtctggaacagggtgtggattcaagaaaacccatggatagaagacaaaactccagtagaatcatgggaggaaatcccatatttggggaaaagagaagaccaatggtgcggctcattgatcgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 7161 - RNA, 9876 nt, synthetic construct
  misc_feature 1..9876: note = derived and/or modified CDS sequence (wt) from DENV-2__DQ645542__SS-prME
  source 1..9876: mol_type = other RNA
actgcaggtgtaatcattatgatgattccaacagtggtggcgttccatttaaccacacgcaacggagaaccacacatgatcgtcagtagacaagagaaagggaaaagtcttctgtttaaaacagagaacggtgtgaacatgtgcacccttatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgctcagagaatcgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgacaaaaacggaagccaaacatccagccactttaaggaagtattgtatagaggcaaagctgaccaacacaacaacagcatctcgctgcccaacacaaggagaacccagcctaaatgaagaacaggacaaaaggtttgtctgcaaacactccatggttgacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaggtaacaccacagagttccattacagaagcagaactgacaggttatggcaccgtcacgatggaatgctctccgagaacgggcctcgactttaatgagatggtgttgctgcaaatggaagacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagttacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgcctttagcggggtttcatggactatgaaaatcctcataggagttgtcatcacatggataggaatgaattcacgcagcacctcactgtctgtgtcactagtattagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggtaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaactgaaagaaaggcaggatgtattttgtgactcaaaactcatgtcagcagccataaaggacaacagggccgtccacgccgatatgggttattggatagaaagcgcacttaatgacacatggaagattgagaaagcctctttcattgaagttaaaagctgccattggccaaagtcacacactctctggagtaatggagtgctagaaagtgagatgataattccaaagaattttgcaggaccagtgtcacagcacaactacagaccaggctatcatacacaaacggcaggaccctggcacctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcaggccattgaaagagaaagaagagaacttggtcaactctttggtcacagccggacatggacagattgacaacttctcactaggagtcttgggaatggcattgttcctggaagaaatgctcaggacccgcgtaggaacgaaacatgcaatattgctagttgcagtttctttcgtgacattgatcacagggaacatgtcttttcgagatttggggagagtgatggtcatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctggctttggggatgatggttctcaaaatagtgagaaacatggaaaagtatcaactagcagtgactatcatggccatcttgtgcgtcccaaatgcagtgatattacaaaacgcatggaaagtgagctgcacaatactggcagtggtgtccgtttccccactgcttttaacatcatcacagcagaaagcagattggataccactggcgttgacgatcaaaggcctcaatccaacagccattttcttaacaaccctctcaagaactagcaagaaaaggagctggccactaaatgaggctattatggcagtcgggatggtgagcattttagctagttccctcttgaagaatgatattcccatgacaggaccattagtagctggagggcttctcactgtgtgttacgtgctcactggaagatcggctgatttggaactggagagagctgctgacgtaagatgggaagaacaggcagagatatcaggaagtagtccaattctgtcaataacaatatcggaagatggtagcatgtcgataaaaaatgaagaagaagaacaaacactgaccatactcattaggacaggactgctggtgatatcaggacttttccctgtgtcaataccaatcacggcagctgcatggtatctgtgggaagtgaaaaaacaacgagctggagtattgtgggatgtcccttcacccccacctgtgggaaaggccgaactggaagatggagcctatagaatcaagcagaaagggattctaggatactcgcagatcggggctggagtttacaaagaaggaacattccacacaatgtggcacgtcacacgcggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacactggaaccataggcgccgtatctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcattgaagacaatccagagattgaagatgacatctttcgaaagaaaagattgaccatcatggacctccacccaggggcgggaaaaacgaagagataccttccagcaatagtcagagaagccataaaacgaggcttgaggacactaatcctggcccccactagagttgtggcggctgaaatggaagaagctctcagaggacttccaataagataccaaacccccgccatcagagctgagcacactgggcgggagattgtggatctaatgtgtcacgccacatttaccatgaggctgctatccccaattagagtaccaaattacaacctaatcatcatggatgaagcccatttcacagacccagcaagcatagcagctagaggatacatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgaatgggtcacggattttaaagggaagactgtttggtttgttccaagcataaaagcaggaaatgatatagcagcttgcctgagaaagaatgggaagaaagtgatacaactcagcaggaagacctttgattctgaatatgtcaagactaggaccaatgattgggactttgtggtcacgacagacatttcagaaatgggcgctaacttcaaggctgagagggttatagaccccaggcgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagtatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaattacgcagacagaagatggtgctttgatggagtcaagaacaatcaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcactagacaacttagcagtcctgcatacggctgaagcaggcggaagggcgtacaatcatgctcttagtgaactgccggagaccctggagacattgcttttactgacactcttggccacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaggcattgcaacccagcaacctgagagcaacatcctggacatagatctacgtcctgcatcagcttggactctatatgctgtggcaacaactttcatcacaccaatgctgagacacagcattgaaaattcctcagtgaatgtgtctctaacggccattgctaaccaagccacagttttaatgggtcttgggaaaggatggccattgtcaaaaatggacatcggagttccccttctcgctatcgggtgctattcacaagttaaccccataactctcacggcggcccttctcttattggtagcacattatgccatcatagggccaggactccaagcgaaagcaactagagaagctcagaaaagagcagcagcgggcattatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgactgggcccatctccacactgtgggaaggaaatccagggagattttggaatacaactattgcagtatcaatggctaacatttttagagggagctacctggccggagccggacttctcttttctatcatgaagaatacggccaacacaagaaggggaactggcaacacaggagagacgcttggagaaaaatggaaaaaccgattgaatgcattggggaagagtgaattccagatctataagaaaagtggaatccaggaggtggatagaaccctagcaaaagaaggcatcaaaagaggagaaacggaccatcacgctgtgtcgcgaggctcggcgaaactgagatggttcgtcgagagaaacctggtcacaccagaagggaaagtaatggacctcggttgcggcagggggggctggtcatactattgtgggggactaaagaatgtaaaagaagtcaaaggcctaacaaaaggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagcggaacccgcaacatcggaattgaaagtgagataccaaatttggacataattgggaaaagaatagaaaaaataaaacaagagcatgaaacatcatggcactatgaccaagaccacccatacaaaacgtgggcctaccatggcagctacgaaacaaaacagactggatcggcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaattaggaaagaaaaagacacctaggatgtgcaccagagaagaattcacaagaaaggtgaggagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagtttggcaaagcaaaaggcagcagagccatatggtacatgtggcttggagcacgcttcttagagtttgaagccctaggattcttgaatgaagatcactggttttcccgagagaactccctgagtggagtggaaggagaagggctgcacaaactaggctacattttaagagacgtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaggccattttcaaattaacgtaccaaaacaaggtggtgcgtgtgcaaagaccaacaccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcagctgacagccacagaagaaattgcagtgaaaaactggttagcaagagtgggacgtgagaggttatcaagaatggctatcagtggagatgattgtgttgtgaaacccttagatgataggtttgcaagcgctctaacagctctaaatgacatgggaaaagttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtctctgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacttggtccatacatgccacacatgagtggatgacaacagaagatatgctgacagtctggaacagggtgtggattcaagaaaacccatggatagaagacaaaactccagtagaatcatgggaggaaatcccatatttggggaaaagagaagaccaatggtgcggctcattgatcgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 7162 - RNA, 9876 nt, synthetic construct
  misc_feature 1..9876: note = derived and/or modified CDS sequence (wt) from DENV-2__AY702036__SS-prME
  source 1..9876: mol_type = other RNA
acagcaggcgtgattgttatgttgattccaacagcgatggcgttccatttaaccacacgcaatggagaaccacacatgatcgttggcaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggctaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtacagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgctaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaatcgtgaaagaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacctccattcggagacagctacatcattataggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcgctggaagttgaagactatggttttggagttttttccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccatgccagagaccattcttgaactgactgatgcgttagccttgggcatgatggtcctcaaaatagtgagaaatatggaaaaataccaattggcagtgactatcatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcgataacaatatcagaagatggcagcatgtcgataaaaaatgaagaggaagagcaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagtattgaagacaatccagagatcgaagatgacattttccgaaagaaaagattgaccatcatggacctccatccaggagcaggaaagacaaaaagataccttccagccatagttagagaagccataaatcgtggcttgagaacattaatcctggctcccactagagtcgtggcagctgagatggaggaagctcttagaggacttccaataagataccaaaccccagccatcagagccgagcacaccgggcgggagatcgtggacctaatgtgtcacgccacatttactatgaggctgctatcaccagtcagagtgccaaattacaacctgattatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagcaggaagacttttgactctgagtatgttaagactagagccaatgattgggactttgtggtcacaactgacatttcagaaatgggtgctaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacttttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtataggaaagatgaccctgggaatgtgttgcataatcacagctagcagcctcctatggtatgcacagatccaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgtcctgcatcagcatggacgctgtatgccgtagctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgtgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattgaacgcactgggaaaaagtgaatttcagatctacaagaaaagtggaatccaggaagtggatagaaccctagcaaaagaaggtatcaaaagaggagaaacggaccaccatgctgtgtcacgaggatcagcaaaactgagatggttcgtcgagagaaatatggtcacaccggaagggaaggtggtggatctcggttgcggcagagggggatggtcatactattgtgggggactaaagaatgtaagagaagtcaaaggcctaacaaaaggaggaccaggacacgaagaacctatccccatgtcaacatatgggtggaatctagtgcgtctgcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaactcgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggaactggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcatctgacagccacagaagaaatcgctgtacagaactggttagcaagagtggggcgtgaaaggctatcaagaatggccatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggcagagcccgcatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 7163 - RNA, 9876 nt, synthetic construct
  misc_feature 1..9876: note = derived and/or modified CDS sequence (wt) from DENV-2__AY702034__SS-prME
  source 1..9876: mol_type = other RNA
acagcaggcgtgattgttatgttgattccaacagcgatggcgttccatttaaccacacgcaatggagaaccacacatgatcgttggcaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggctaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtacagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgctaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaatcgtgaaagaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacctccattcggagacagctacatcattataggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccatgccagagaccattcttgaactgactgatgcgttagccttgggcatgatggtcctcaaaatagtgagaaacatggaaaaataccaattggcagtgactatcatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagtattgaagacaatccagagatcgaagatgacattttccgaaagaaaagattgaccatcatggacctccatccaggagcaggaaagacaaaaagataccttccagccatagttagagaagccataaatcgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcacgccacatttactatgaggctgctatcaccagtcagagtgccaaattacaacctgattatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagcaggaagacttttgactctgagtatgttaagactagagccaatgattgggactttgtggtcacaactgacatttcagaaatgggtgctaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacttttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacagctagcagcctcctatggtatgcacagatccaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgtcctgcatcagcatggacgctgtatgccgtagctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattgaacgcactgggaaaaagtgaatttcagatctacaagaaaagtggaatccaggaagtggatagaaccctagcaaaagaaggtatcaaaagaggagaaacggaccaccatgctgtgtcacgaggatcagcaaaactgagatggttcgtcgagagaaatatggtcacaccggaagggaaggtggtggatctcggttgcggcagagggggatggtcatactattgtgggggactaaagaatgtaagagaagtcaaaggcctaacaaaaggaggaccaggacacgaagaacctatccccatgtcaacatatgggtggaatctagtgcgtcttcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaactcgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggccatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggcagagcccgcatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 7164 - RNA, 9876 nt, synthetic construct
  misc_feature 1..9876: note = derived and/or modified CDS sequence (wt) from DENV-2__AF208496__SS-prME
  source 1..9876: mol_type = other RNA
acagcaggcgtgattgttatgttgattccaacagcgatggcgttccatctaaccacacgcaatggagaaccacacatgatcgttggcaggcaggagaaagggaaaagtcttctgttcaaaacagaggatggtgttaacatgtgtaccctcatggccatagaccttggtgaattgtgtgaagatacaatcacgtacaagtgtcctttccttagacaaaatgaacctgaagacatagattgttggtgcaactttacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcctactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaactacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtacagccagaaaatttggaatacaccatcgtgataacacctcactcaggagaagagcacgctgtaggcaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgccaagaaacaggatgttgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccgatcgtaacagaaaaagatagcccagtcaacatagaagcagaacctccattcggagacagctacatcatcataggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcgttgtgagctggaaaaataaagaactaaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgctgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttacgaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggactcgagtaggaacgaaacatgcaatactgctagttgcagtatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccatgccagagaccattcttgaactgactgatgcgttagccttgggcatgatggtcctcaaaatagtgagaaatatggaaaaataccaattagcagtgactatcatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacttaatatcatatggaggaggctggaagctagaaggagaatggaaggaaggagaggaagtccaagtcctggcattggaacctggaaaaaatcccagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcacgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagtagagacccatttcctcagagcaatgcaccaatcatggatgaggaaagagaaatccctgagcgttcgtggaattcaggacatgaatgggtcacggattttaaagggaaaactgtttggtttgttccaagtataaaagcaggaaatgacatagcagcttgtcttaggaaaaatggaaagaaagtgatacaactcagcaggaagacttttgactctgagtatgttaagactagagccaatgattgggactttgtggtcacaactgacatttcagaaatgggtgctaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaatacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagcagcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattgcaacccaggaatctgagagcaacatcctggacatagatctacgtcctgcatcagcatggacgctgtatgccgtagctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggtatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattgaacgcactgggaaaaagtgaatttcagatctacaagaaaagtggaatccaggaagtggatagaaccctagcaaaagaaggtatcaaaagaggagaaacggaccaccatgctgtgtcacgaggatcagcaaaactgagatggttcgtcgagagaaatatggtcacaccggaagggaaggtggtggatctcggttgcggcagagggggatggtcatactattgtgggggactaaagaatgtaagagaagtcaaaggcctaacaaaaggaggaccaggacacgaagaacctatccccatgtcaacatatgggtggaatctagtgcgtctgcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaactcgcaacattggaattgaaagtgagataccaaatctagacataataggaaagagaatagagaaaataaaacaagagcatgaaacatcatggcattatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacggcaggatgggacacaagaatcacactagaagacttaaaaaatgaagaaatggtaacaaaccacatgaaaggagaacacaagaaactagccgaggccatattcaaattaacgtaccaaaacaaggtagtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggccatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcctgtttggggaagtcttacgcccaaatgtggaccctgatgtacttccacaaacgtgacctcagactggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccagacagcaataaatcaagtcagatcccttataggcaatgaggaatacacagattacatgccatccatgaagagattcagaagggaagaggaagaggcaggtgtcctgtggtag

SEQ ID NO: 7165 - RNA, 9876 nt, synthetic construct
  misc_feature 1..9876: note = derived and/or modified CDS sequence (wt) from DENV-2__AY702040__SS-prME
  source 1..9876: mol_type = other RNA
actgcaggcatgatcatcatgctgattccaacagtgatggcgtttcatctgaccacacgcaacggagaaccacacatgatcgtcagtagacaagaaaaagggaaaagccttctgtttaagacaaaggatggcacgaacatgtgtactctcatggccatggaccttggtgagttgtgtgaagacacaatcacgtataagtgtccttttctcaagcagaacgaaccagaagacatagattgttggtgcaactccacgtccacatgggtaacttacgggacatgtaccaccacaggagagcacagaagagaaaaaagatcagtggcgcttgttccacacgtgggaatgggattggagacacgaactgaaacatggatgtcatcagaaggggcctggaaacatgcccagagaattgaaacttggattctgagacatccaggctttaccataatggccgcaatcctggcatacaccataggaacgacgcatttccaaagagtcctgatattcatcctactgacagccatcgctccttcaatgacaatgcgctgcataggaatatcaaatagggactttgtggaaggagtgtcaggagggagttgggttgacatagttttagaacatggaagttgtgtgacgacgatggcaaaaaataaaccaacattggactttgaactgataaaaacagaagccaaacaacccgccaccttaaggaagtactgtatagaggctaaactgaccaacacgacaacagactcgcgttgcccaacacaaggggaacccaccctgaatgaagagcaggacaaaaggtttgtctgcaaacattccatggtagacagaggatggggaaatggatgtggattgtttggaaaaggaggcatcgtgacctgtgctatgttcacatgcaaaaagaacatggaaggaaaaattgtgcagccagaaaacctggaatacactgtcgtgataacacctcattcaggggaagaacatgcagtcggaaatgacacaggaaaacatggtaaagaagtcaagataacaccacagagctccatcacagaggcggaactgacaggctatggcactgtaacgatggagtgctctccaagaacgggcctcgacttcaatgagatggtgttgctgcaaatggaagacaaagcttggctggtgcacagacaatggttcctagacctaccgttgccatggctgcccggagcagacacacaaggatcaaattggatacagaaagagacattggtcaccttcaaaaatccccatgcgaaaaaacaggatgttgttgtcctaggatcccaagagggggccatgcatacagcactcacaggggccacggaaatccagatgtcatcaggaaacctgctgttcacaggacatctcaaatgcaggctgagaatggacaaattacaacttaaagggatgtcatactccatgtgcacaggaaaatttaaaattgtgaaggaaatagcagaaacgcaacatggaacaatagtcattagagtacaatatgaaggagacggctctccatgcaagatcccttttgagataatggatctggaaaaaagacatgttttgggccgcctgatcacagtcaacccaattgtaacagaaaaggacagtccagtcaacatagaagcagaacctccattcggagacagctacatcatcataggagtggaaccaggacaattaaagctggactggttcaagaaaggaagttccatcggtcaaatgtttgagacaacaatgaggggagcgaaaagaatggccatcttgggcgacacagcctgggattttggatctctgggaggagtgttcacatcaataggaaaagctctccaccaggtttttggagcaatctacggggctgctttcagtggggtttcatggactatgaagatccttataggagttatcatcacatggataggaatgaactcacgtagcacatcactgtctgtgtcactggtattagtgggaatcgtgacactgtacttgggagttatggtgcaagccgatagtggttgcgttgtgagctggaagaacaaagaactaaaatgtggcagtggaatattcgtcacagataacgtgcatacatggacagaacaatacaagttccaaccagaatccccttcaaaactggcttcagccatccagaaagctcacgaagaaggcatctgtggaatccgctcagtaacaagactggaaaatcttatgtggaaacagataacatcagaattgaatcatattctatcagaaaatgaagtgaaactgaccatcatgacaggagacatcaaaggaatcatgcaggtaggaaaacgatctctgcggcctcaacccactgagttgaggtattcatggaaaacatggggtaaagcgaaaatgctctccacagaactccacaatcagaccttcctcattgatggtcccgaaacagcagaatgccccaacacaaacagagcttggaattcactagaagttgaggactatggctttggagtattcactaccaatatatggctaagattgagagaaaagcaggatgcattttgtgacccaaaactcatgtcagcggccataaaggacaacagagccgtccatgctgatatgggttattggatagaaagcgcactcaatgatacatggaagatagagaaagcttctttcattgaagtcaaaagttgccactggccaaagtcacacactctatggagtaatggagtgctagaaagcgagatggtaattccaaagaatttcgctggaccagtgtcacaacataataacagaccaggctatcacacacaaacagcaggaccttggcatctaggcaagcttgagatggactttgatttctgcgaagggaccacagtggtggtaaccgaggaatgtggaaacagagggccttctttaagaacaaccactgcctcaggaaaactcataacggaatggtgttgtcgatcttgcacactaccaccactaagatacagaggtgaggatggatgctggtacgggatggaaatcagaccattgaaagagaaagaagaaaatctggtcagttctctggtcacagccggacatgggcagattgataatttctcattaggaatcttgggaatggcgctgttccttgaagaaatgctcaggactcgagtaggaacgaaacatgcaatactactagtcgcagtctctttcgtaacgttaatcacagggaacatgtcttttagagacctgggaagagtgatggttatggtgggtgccaccatgacagatgacataggcatgggtgtgacttatcttgctctactagcagccttcaaagtcagaccaacctttgcagctggactgctcttgagaaaactgacctccaaggaattaatgatgaccaccataggaatcgttcttctctcccagagtagcataccagagaccattcttgagctgaccgatgcgttagccttaggcatgatggtcctcaagatggtgagaaacatggaaaaatatcagctggcagtgactatcatggctattttgtgcgtcccaaatgctgtgatattacagaacgcatggaaagtgagttgcacaatactggcagtggtgtctgtttcccccctgctcttgacatcctcacagcagaaagcggactggataccattagcgttgacgatcaaaggcctcaatccaacagccatttttctaacaaccctctcaagaaccagcaagaaaaggagctggcctttaaacgaggccatcatggcggttgggatggtgagtatcttggccagctctctcttgaagaacgacatccccatgacaggaccattagtggctggagggcttcttactgtgtgctacgtactaactgggcggtcagccgatctggaactagagagagctaccgatgtcaaatgggatgatcaggcagagatatcaggtagcagtccaattctgtcaataataatatcagaagatggcagcatgtcaataaagaatgaagaggaagagcaaacactgaccatactcattagaacaggattgcttgtgatctcaggactctttccggtatcaataccaattacagcagcagcatggtacctgtgggaagtaaagaaacaacgggctggagtgttgtgggatgtcccctcaccaccacccgtgggaagggctgaattggaagatggagcctacagaatcaagcaaaaaggaattcttggatattcccagatcggagctggagtttacaaagaaggaacatttcacaccatgtggcacgtcacacgtggcgcagtcctaatgcataaggggaagaggattgaaccatcatgggcggacgtcaagaaagacttaatatcatatggaggaggttggaagctagaaggagaatggaaagaaggagaagaagtccaggtcttggcattggagcctgggaaaaatccaagagccgtccaaacaaaacctggcctttttagaaccaatactggaaccataggcgccgtatctctggacttttcccctgggacgtcaggatctccaatcgttgacaaaaaaggaaaagttgtaggtctctatggcaatggtgttgttacaaggggtggagcatatgtgagtgccatagctcagactgaaaaaagcattgaagacaatccagagattgaagatgacatctttcgaaagagaagattgactatcatggatctccacccaggagcaggaaagacaaagagatacctcccggccatagttagagaggccataaaaagaggcttgagaacactaatcctagcccccactagagtcgtggcagctgaaatggaggaagcccttagaggacttccaataagataccaaactccagccatcagggctgagcacaccgggcgggagatcgtggacttaatgtgtcatgccacatttaccatgaggctgctatcaccaatcagggtgccaaattacaacctgatcatcatggacgaagcccattttacagatccagcaagcatagcagctaggggatacatctcaactcgagtggagatgggtgaggcagctggaatttttatgacagccactcctccgggtagcagagatccatttcctcagagtaatgcaccaatcatggacgaagaaagagaaattccggaacgttcatggaactccgggcacgagtgggtcacggatttcaaaggaaagactgtctggtttgttccaagcataaaaaccggaaatgacatagcagcctgcctgagaaagaatggaaagagggtgatacaactcagtaggaagacctttgattctgaatacgtcaagactagaaccaatgactgggatttcgtggttacaactgacatttcggaaatgggtgccaactttaaagctgagagggttatagaccccagacgctgcatgaaaccagttatactgacagacggcgaagagcgggtgattctagcaggacccatgccagtgacccactccagtgcagcacaaagaagagggagaataggaaggaatccaaggaatgaaaatgatcaatacatatatatgggagaacccctggaaaatgatgaagactgtgcgcactggaaggaagctaagatgctcctagataacatcaacacacctgaaggaatcattcccagcatgttcgagccagagcgtgaaaaggtggatgccattgacggtgaatatcgcttgagaggagaagcacggaaaacttttgtggacctaatgagaagaggagacctaccagtctggttggcttataaagtggcagctgaaggtatcaactacgcagacagaagatggtgttttgacggaaccagaaataatcaaatcttggaagaaaatgtggaagtggaaatctggacaaaggaaggggaaaggaaaaaattgaaacctagatggttagatgctaggatctactccgacccactggcgctaaaagaattcaaggaattcgcagccggaagaaagtccttaaccctgaacctaatcacagagatgggcagactcccaacttttatgactcagaaggccagagatgcactagacaacttagcggtgctgcacacggctgaagcgggtggaaaagcatacaatcatgccctcagtgaactaccggagaccctggagacattgcttttgctgacactgttggccacagtcacgggaggaatctttctattcctgatgagcggaaggggtatagggaagatgaccctgggaatgtgctgcataatcacggccagcatactcttatggtatgcacaaatacaaccacattggatagcagcttcaataatattggagttctttctcatagtattgctcattccagaaccagagaagcagaggacaccccaggataatcaattgacttatgtcatcatagccatcctcacagtggtggccgcaaccatggcaaacgaaatgggttttctagaaaaaacaaagaaagacttcggactgggacacattgcaactcagcaacctgagagcaacattctggacatagatctacgtcctgcatcagcatggacgttgtatgccgtggcaacaacatttatcacaccaatgttgagacatagcattgaaaattcctcagtaaatgtgtccctaacagccatagctaaccaagccacagtgctaatgggtctcgggaaaggatggccattgtcaaagatggacattggagttcccctccttgccattgggtgttactcacaagtcaaccctataactctcacagcggctcttcttttgttggtagcacattatgccatcataggaccgggacttcaagccaaagcaaccagagaagctcagaaaagagcagcggcgggcatcatgaaaaacccaactgtggatggaataacagtgatagatctagatccaataccctatgatccaaagtttgaaaagcagttgggacaagtaatgctcctagtcctttgtgtgacccaagtgctgatgatgaggactacgtgggctttgtgtgaagccttaactctagcaaccggacccgtgtccacattgtgggaaggaaatccagggagattctggaacacaaccattgcagtgtcaatggcaaacatcttcagagggagttaccttgctggagctggacttctcttttctatcatgaagaacacaaccagcgcgagaagaggaactggcaacatgggagaaacgctaggagagaaatggaaaagcagactgaacgcattggggaaaagtgaattccagatctacaaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattgaagaatgtaagagaagttaaaggcttaacaaaaggaggaccaggacacgaagaacctatccctatgtcaacatatgggtggaatctagtacgcttacagagcggagttgatgttttttttgttccaccagagaagtgtgacacattgttgtgtgacataggggaatcatcaccaaatcccacggtagaggcgggacgaacactcagagtccttaacctagtggaaaattggctgaacaataacacccaattttgcgtaaaggttcttaacccgtacatgccctcagtcattgaaagaatggaaaccttacaacggaaatacggaggagccttggtgagaaatccactctcacggaattccacacatgaaatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaacattggaattgaaagtgagacaccgaacctagacataattgggaaaagaatagaaaaaataaaacaggagcatgaaacgtcatggcactatgaccaagaccacccatacaaaacatgggcttaccatggtagctatgaaacaaaacagacaggatcagcatcatccatggtgaacggagtagtcagactgctgacaaagccctgggacgttattccaatggtgacacagatggcaatgacagacacaactcctttcggacaacagcgtgtcttcaaagagaaggtggatacgagaacccaagaaccaaaagaaggcacaaaaaaactaatgaaaatcacagcagagtggctctggaaagaactaggaaagaaaaagacacctagaatgtgcaccagagaagaattcacaaaaaaggtaagaagtaatgcagccttgggggccatatttaccgatgagaacaagtggaagtcggcgcgtgaggctgttgaagacaataggttttgggagctggttgacaaggaaagaaacctccatcttgaaggaaaatgtgaaacatgtgtatacaacatgatgggaaaaagagagaaaaaactaggagagtttggtaaagcaaaaggcagcagagccatatggtacatgtggctcggagcacgcttcttagagtttgaagccctaggatttttgaatgaagaccattggttctccagagagaactccctgagtggagtggaaggagaagggctgcataaactaggttacatcttaagagaggtgagcaagaaagaaggaggagcaatgtatgccgatgataccgcaggctgggacacaagaatcacaatagaggatttaaaaaatgaagaaatgataacgaaccacatggcaggagaacacaagaaacttgccgaggccatttttaaattgacgtaccaaaacaaggtggtgcgtgtgcaaagaccaacaccaagaggcacggtaatggacatcatatcgagaaaagaccaaaggggtagtggacaagttggcacctatggcctcaacactttcaccaacatggaagcacaactaattaggcaaatggagggggaaggaatcttcaaaagcatccagcacttgacagcctcagaagaaatcgctgtgcaagattggctagtaagagtagggcgtgaaaggttgtcaagaatggccatcagtggagatgattgtgttgtgaaacctttagatgatagatttgcaaaagctctaacagctctaaatgacatgggaaaggttaggaaggacatacagcaatgggagccctcaagaggatggaacgactggacacaggtgcccttctgttcacaccattttcacgagttaattatgaaagatggtcgcacacttgtagttccatgcagaaatcaagatgaattgatcggcagagcccgaatttcccagggagctgggtggtctttacgggagacggcctgtttgggaaagtcttacgcccaaatgtggagcttgatgtacttccacagacgtgatctcaggctagcggcaaatgccatttgctcggcagtcccgtcacactgggttccaacaagccggacaacctggtctatacacgccagccatgaatggatgacgacggaagacatgttgacagtttggaacagagtgtggatcctagagaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagatttagaagagaagaggaagaggcaggagttttgtggtag

SEQ ID NO: 7166 - RNA, 9876 nt, synthetic construct
  misc_feature 1..9876: note = derived and/or modified CDS sequence (wt) from DENV-2__AY037116__SS-prME
  source 1..9876: mol_type = other RNA
actgcaggtataattattatgatgattccaacagtgatggcgttccatttaaccacacgcaacggagaaccacacatgatcgtcagtagacaagagaaggggaaaagtcttctgtttaaaacagagaacggtgtgaacatgtgtaccctcatggccatggaccttggtgaattgtgtgaagacacaatcacttataattgtcctcttctcaggcagaatgaaccagaagacatagactgtgggtgccactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggcttcaccataatggcagcaatcctggcatacaccataggaacgacatatttccaaagagtcctgattttcatcttactgacagctgtcactccttcaatgacaatgcgttgtataggaatatcaaatagggactttgtggaaggggtttcaggaggaagctgggttgacatagtcttggaacatggaagctgtgtgacgacgatggcgaaaaataaaccaacattggattttgaactggtaaaaacagaagccaaacatcccgccactctaaggaagtattgtatagaagcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcaaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaattgttacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacattatatttgggagttatggtgcaggccgatagtggctgcgttgtgagttggaaaaacaaagaactgaaatgtggcagtgggatttttatcacagacaacgtgcacacatggacagaacaatacaaattccaaccagaatccccttcaaagctggcttcagctatccagaaggctcatgaagagggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcactagaagttgaagactatggctttggagtattcaccaccaacatatggctgaaattgaaagaaaggcaggatgtattttgtgactcaaaactcatgtcagcagccataaaagacaacagagccgtccacgccgatatgggttattggatagaaagcgcactcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccctggcatctaggtaggcttgagatggactttgatttctgcgaaggaaccacagtggtagtgactgaggactgtggaaacagaggaccctctttaagaacaactactgcttctggaaaactcataacagaatggtgctgccgatcctgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatctcgccctattagcagccttcaaagtcagaccaactttcgcagctggactactcttaagaaagctgacctccaaggaattgatgatgaccaccataggaatcgtactcctctctcagagcaccataccagagactatacttgaactgactgacgcgtgggctttggggatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggagagagctgctgacgtaagatgggaagaacaggcagagatatcaggaagtagtccaattctgtcaataacaatatcggaagatggtagcatgtcgataaaaaatgaagaagaagaacaaacactgaccatactcattagaacaggactgctggtgatatcaggactttttcccgcgtcaataccaatcacggcagctgcatggtacctgtgggaagtgaaaaaacaacgagccggagtattgtgggatgtcccttcacccccacctgtgggaaaggccgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggcgccgtatctctggacttctctcctggaacgtcaggatctccaattgtcgacaaaaaaggaaaagttgtgggcctttatggcaacggtgtcgtcacaaggagtggagcatatgtgagtgccatagcccagactgaaaaaagcatcgaagacaatccagagattgaagatgacatctttcgaaagaaaagattgaccatcatggacctccacccaggagcgggaaaaacaaagagataccttccagcaatagttagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctgctatcaccaattagagtgccaaattacaacctgatcatcatggatgaagcccatttcacagacccagcaagcatagcagctagaggatacatttcaactcgagtagagatgggtgaagcagctgggattttcatgacagctactcctcctggaagcagagacccatttcctcagagcaatgcaccaatcatggatgaagaaagggaaatccctgagcgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggctgagagggttatagaccccagacgctgcatgaaaccagtcatactaactgacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggatgccattgatggtgaataccgcttgagaggagaagcgaggaaaacttttgtggacctaatgagaagaggagacctaccagtctggctagcctacagagtggctgctgaaggtatcaactacgcagacagaagatggtgctttgatggagtcaagaacaaccaaatcttggaagaaaatgtggaagtggaaatttggacaaaagaaggagaaaggaagaaattaaaacccagatggttggatgccaggatctactctgacccactggcgctcaaagaattcaaggaattcgcagctggaagaaagtccctgactctgaatctaatcacagagatgggtaggctcccaaccttcatgacccagaaagcaaggaatgcactggacaacttagcagtcctgcatacggctgaagcaggcggaagggcgtacaatcatgctcttagtgaactgccggagaccctggagacattgcttttactgacacttttggccacagtcacgggcggaatcttcctgttcttgatgagcggaaagggtatagggaagatgaccctgggaatgtgctgcataatcacggccagtattctcctatggtatgcacaaatacagccacactggatagcagcctcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaagcattgcaacccagcaacctgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcacggcagcccttctcttattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgacccaagtattgatgatgaggactacatgggctttatgtgaagctctaaccttagcgaccgggcccatctctacactgtgggaaggaaatccagggagattttggaatacaactattgcagtgtcaatggctaacatttttagagggagttacctggccggagccggacttctcttttctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaaaagaggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgttttttttactccgccagaaaagtgtgacacattactgtgtgacataggggagtcgtcaccaaaccccacggttgaggcaggacgaacactcagagttctaaacttagtggaaaattggctgaacaacaacacccaattttgcataaaggttctcaacccatatatgccctcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagcggaacccgcaacatcggaattgaaagtgagacaccaaatttagacataattgggaaaagaatagagaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacatcatccctatggtgacacagatggcaatgacagacacgactccatttgggcaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcacctgacagtcacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtactcgtagttccatgtagaaaccaagatgaactgattggtagggcccgaatttcccagggagccgggtggtccttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 7167 - RNA, 9876 nt, synthetic construct
  misc_feature 1..9876: note = derived and/or modified CDS sequence (wt) from DENV-2__AF169678__SS-prME
  source 1..9876: mol_type = other RNA
tctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgaggggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagaatctcataaccaaacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagaaaagactgaccatcatggacctccacccaggggcaggaaagacgaaaagataccttccggccatagtcagagaagctataaaacggggtttgaggacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaattcagaacaaccaaatcctggaagaaaatgtggaagtggaaatctggacaaaagaaggggaaaggaagaaattgaaacccaggtggctggacgctaggatctattctgacccactggcgctaaaagaattcaaagaatttgcagctggaagaaagtctctgaccctgaacctaatcacagaaatgggtaggcttccaactttcatgactcagaaggcaagagacgcattggacaacttagcagttctgcacacggctgaagcaggtggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggactccaagcaaaagcaaccagagaagctcagaaaagagcagcggcgggtattatgaaaaacccaaccgtcgatggaataacagtgatcgatctagatccaataccttatgatccaaagtttgaaaagcagttgggacaagtaatgctcctagtcctctgtgtgactcaagtattgatgatgaggactacatgggctctgtgtgaggctttaaccttagcgacagggcccatctccacattgtgggaaggaaatccagggaggttttggaacactaccattgcagtgtcaatggctaatatttttagagggagttacttggctggagctggacttctcttttccatcatgaagaacacaaccaacacaagaaggggaactggcaacataggagagacgcttggagagaaatggaaaagccgactgaacgcactggggaaaagtgaattccagatctacaagaaaagtggaatccaggaagtggatagaacattagcaaaagaaggcatcaaaagaggagaaacggaccatcacgctgtgtcgcgaggctcagcaaaactgagatggttcgttgagagaaacatgatcacaccagaagggaaagtagtggacctcggttgtggcagaggaggctggtcatactattgtgggggactaaagaatgtaagagaagtgaaaggcctgacaaagggaggaccaggacacgaagaacccatccccatgtctacatatgggtggaacctagtgcgtcttcaaagtggagttgacgttttcttcactccgccagaaaagtgcgacacattgctgtgtgacataggggagtcgtcaccaaatcccacggtagaagcaggacggacactcagagtcctcaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgaaacacaagaaagccacctacgagccagatgttgacctaggaagcggaacccgcaacattggaattgaaagtgaggtaccaaacctggacataattgggaaaagaatagaaaaaataaaacaagagcatgaaacatcatggcactatgaccaagatcacccatacaaaacatgggcttaccatggtagctacgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagagaagaagctaggggagttcggcaaggcaaaaggcagcagagccatatggtatatgtggcttggagcacgttttttagagtttgaagccctaggattcttgaatgaagatcactggttctccagagagaactccctgagtggagtggaaggagaagggctgcacaagctaggctacatcctaagagacgtgagcaagaaagagggaggagcaatgtatgccgatgacaccgcaggatgggacacaagaatcacactggaagatctaaaaaatgaagaaatggtaacaaaccacatggaaggagaacacaagaaactagctgaggctattttcaaattaacgtaccaaaacaaggtggtgcgtgtgcaaagaccaacaccaagaggcacagtaatggatatcatatcaagaagagaccaaagaggtagcgggcaagttggtacctatggactcaacactttcactaatatggaagcccaactaatcagacagatggaaggagaaggagtctttaaaaacattcagcacctgacagccacagaagaaattgccgtgcaaaactggttagcaagagtggggcgcgaaaggttatcaagaatggccatcagtggagatgactgtgtagtgaaacctttagatgacaggttcgcaagtgctttgacagctctaaatgacatgggaaaggtcaggaaggacatacaacaatgggaaccttcaagagggtggaatgattggacacaggtgcccttctgttcacaccatttccatgagttaatcatgaaagacggtcgtgtacttgtagttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 7168 - RNA, 9876 nt, synthetic construct
  misc_feature 1..9876: note = derived and/or modified CDS sequence (wt) from DENV-2__AF169679__SS-prME
  source 1..9876: mol_type = other RNA
tctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgaggggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacgctgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccaaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattggcagtgactatcatggctatcttgtgcgtcccaaatgcagtgatattacaaaatgcatggaaagtgagttgcacaatactggcagtggtgtccgtttccccactgatattgacatcctcacagcagaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgacattcccatgacaggaccactagtggctggagggctcctcactgtgtgctacgtgctcactggacgatcggccgacttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtcctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagattgaagatgacattttccgaaagagaagactgaccatcatggacctccacccaggggcgggaaagacgaaaagataccttccggccatagtcagagaagccataaaacggggtttgaggacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggaaatgggtgaggcagctgggattttcatgacagccactcccccgggaagtagagatccatttcctcagagcaatgcaccaatcatggatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacacctgaaggaatcattcccagtatgtttgaaccagagcgtgaaaaagtggatgccattgatggtgaataccgcttgagaggagaagcacggaaaacctttgtggacttaatgagaagaggagacctaccagtctggttggcctacaaagtggcagctgaaggcatcaactatgcagacagaaggtggtgttttgatggaatcaggaacaaccaaatcctggaagaaaatgtggaagtggaaatctggacaaaagaaggggaaaggaagaaattgaaacccaggtggctggacgctaggatctattctgacccactggcgctaaaagaattcaaagaatttgcagctggaagaaagtctctgaccctgaacctaatcacagaaatgggtaggcttccaactttcatgactcagaaggcaagagacgcattggacaacttagcagttctgcacacggctgaagcaggtggaagggcgtacaatcatgccctcagtgaactgccggagaccctagagacactgcttttactgacacttctggctacagtcacaggaggaatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggactccaagcaaaagcaaccagagaagctcagaaaagagcagcggcgggtattatgaaaaacccaaccgtcgatggaataacagtaatcgatctagatccaataccttatgatccaaagtttgaaaagcagttgggacaagtaatgctcctagtcctctgtgtgactcaagtattgatgatgaggactacatgggctctgtgtgaggctttaaccttagcgacagggcccatctccacattgtgggaaggaaatccagggaggttttggaacactaccattgcagtgtcaatggctaatatttttagagggagttacttggctggagctggacttctcttttccatcatgaagaacacaaccaacacaagaaggggaactggcaacataggagagacgcttggagagaaatggaaaagccgactgaacgcactggggaaaagtgaattccagatctacaagaaaagtggaatccaggaagtggatagaacattagcaaaagaaggcatcaaaagaggagaaacggaccatcacgctgtgtcgcgaggctcagcaaaactgagatggttcgttgagagaaacatgatcacaccagaagggaaagtagtggacctcggttgtggcagaggaggctggtcatactattgtgggggactaaagaatgtaagagaagtgaaaggcctgacaaagggaggaccaggacacgaagaacccatccccatgtctacatatgggtggaacctagtgcgtcttcaaagtggagttgacgttttcttcactccgccagaaaagtgcgacacattgctgtgtgacataggggagtcgtcaccaaatcccacggtagaagcaggacggacactcagagtcctcaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgaaacacaagaaagccacctacgagccagatgttgacctaggaagcggaacccgcaacattggaattgaaagtgaggtaccaaacctggacataattgggaaaagaatagaaaaaataaaacaagagcatgaaacatcatggcactatgaccaagatcacccatacaaaacatgggcttaccatggtagctacgaaacaaaacaaactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagagaagaagctaggggagttcggcaaggcaaaaggcagcagagccatatggtatatgtggcttggagcacgttttttagagtttgaagccctaggattcttgaatgaagatcactggttctccagagagaactccctgagtggagtggaaggagaagggctgcacaagctaggctacatcctaagagacgtgagcaagaaagagggaggagcaatgtatgccgatgacaccgcaggatgggacacaagaatcacactggaagatctaaaaaatgaagaaatggtaacaaaccacatggaaggagaacacaagaaactagctgaggctattttcaaattaacgtaccaaaacaaggtggtgcgtgtgcaaagaccaacaccaagaggcacagtaatggatatcatatcaagaagagaccaaagaggtagcgggcaagttggtacctatggactcaacactttcactaatatggaagcccaactaatcagacagatggaaggagaaggagtctttaaaaacattcagcacctgacagccacagaagaaattgccgtgcaaaactggttagcaagagtggggcgcgaaaggttatcaagaatggccatcagtggagatgactgtgtagtgaaacctttagatgacaggttcgcaagtgctttgacagctctaaatgacatgggaaaggtcaggaaggacatacaacaatgggaaccttcaagagggtggaatgattggacacaggtgcccttctgttcacaccatttccatgagttaatcatgaaagacggtcgtgtacttgtagttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 7169 - RNA, 9876 nt, synthetic construct
  misc_feature 1..9876: note = derived and/or modified CDS sequence (wt) from DENV-2__AF169680__SS-prME
  source 1..9876: mol_type = other RNA
tctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtataatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaaactttctcattgatggccccgaaacggcagaatgccccaacacaaatagagcttggaactcgttggaggtcgaagactacggctttggagtgttcaccaccaacgtatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctctcaaagcactataccagagaccattcttgaattgactgatgcgttagccttaggcatgatggtcctcaaaatagtaagaaacatggaaaagtatcaattagcagtgactatcatggctatcttgtgcgtccctaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaacgacaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaaagatgaccatcatggacctccacccaggggcgggaaagacgaaaagataccttccggccatagtcagagaagctataaaacggggtttgaggacattaatcttggcccccaccagagtcgtggcagctgaaatggaggaagctctaaggggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggtgaataccgcttgagaggagaagcaaggaaaacctttgtggacttaatgagaagaggagacctaccagtctggttggcctacaaagtggcagctgaaggcatcaactatgcagacagaaggtggtgttttgatggaatcaggaacaaccaaatcctggaagaaaatgtggaagtggaaatctggacaaaagaaggggaaaggaagaaattgaaacccagatggctggacgctaggatctattctgacccactggcgctaaaagaattcaaagaatttgcagctggaagaaagtctctgaccctgaacctaatcacagaaatgggtaggcttccaactttcatgactcagaaggcaagagacgcattggacaacttagcagttctgcacacggctgaagcaggtggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggactccaagcaaaagcaaccagagaagctcagaaaagagcagcggcgggtattatgaaaaacccatccgtcgatggaataacagtgatcgatctagatccaataccttatgatccaaagtttgaaaagcagttgggacaagtaatgctcctagtcctctgtgtgactcaagtattgatgatgaggactacatgggctctgtgtgaggctttaaccttagcgacagggcccatctccacattgtgggaaggaaatccagggaggttttggaacactaccattgcagtgtcaatggctaatatttttagagggagttacttggctggagctggacttctcttttccatcatgaagaacacaaccaacacaagaaggggaactggcaacataggagagacgcttggagagaaatggaaaagccgactgaacgcactggggaaaagtgaattccagatctacaagaaaagtggaatccaggaagtggatagaacattagcaaaagaaggcatcaaaagaggagaaacggaccatcacactgtgtcgcgaggctcagcaaaactgagatggttcgttgagagaaacatgatcacaccagaagggaaagtactggacctcggttgtggcagaggaggctggtcatactattgtgggggactaaagaatgtaagagaagtgaaaggcctgacaaagggaggaccaggacacgaagaacccatccccatgtctacatatgggtggaacctagtgcgtcttcaaagtggagttgacgttttcttcactccgccagaaaagtgcgacacattgctgtgtgacataggggagtcgtcaccaaatcccacggtagaagcaggacggacactcagagtcctcaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgaaacacaagaaagccacctacgagccagatgttgacctaggaagcggaacccgcaacattggaattgaaagtgaggtaccaaacctggacataattgggaaaagaatagaaaaaataaaacaagagcatgaaacatcatggcactatgaccaagatcacccatacaaaacgtgggcataccatggtagctacgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagagaagaagctaggggagttcggcaaggcaaaaggcagcagagccatatggtatatgtggcttggagcacgttttttagagtttgaagccctaggattcttgaatgaagatcactggttctccagagagaactccctgagtggagtggaaggagaagggctgcacaagctaggctacatcctaagagacgtgagcaagaaagagggaggagcaatgtatgccgatgacaccgcaggatgggacacaagaatcacactggaagatctaaaaaatgaagaaatggtaacaaaccacatggaaggagaacacaagaaactagctgaggctattttcaaattaacgtaccaaaacaaggtggtgcgtgtgcaaagaccaacaccaagaggcacagtaatggatatcatatcaagaagagaccaaagaggtagcgggcaagttggtacctatggactcaacactttcactaatatggaagcccaactaatcagacagatggaaggagaaggagtctttaaaaacattcagcacctgacagccacagaagaaattgccgtgcaaaactggttagcaagagtggggcgcgaaaggttatcaagaatggccatcagtggagatgactgtgtagtgaaacctttagatgacaggttcgcaagtgctttgacagctctaaatgacatgggaaaggtcaggaaggacatacaacaatgggaaccttcaagagggtggaatgattggacacaggtgcccttctgttcacaccatttccatgagttaatcatgaaagacggtcgtgtacttgtagttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 7170 - RNA, 9876 nt, synthetic construct
  misc_feature 1..9876: note = derived and/or modified CDS sequence (wt) from DENV-2__AF169682__SS-prME
  source 1..9876: mol_type = other RNA
tctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtccctaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaagcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaagataccttccggccatagtcagagaagctataaaacggggtttgagaacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggaggaagggcgtacaatcatgccctcagtgaattgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggtgttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggagagacgcttggagagaaatggaaaagccgactgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtagtggacctcggttgtggcagaggaggctggtcttactattgtggaggactaaagaatgtaagagaagtgaaaggcctaacaaaaggaggaccaggacacgaagaacccatccccatgtctacatatgggtggaacctagtgcgtcttcaaagtggagttgacgttttcttcactccgccagaaaagtgcgacacattgctgtgtgacataggggagtcgtcaccaaatcccacggtagaagcaggacggacactcagagtcctcaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgaaacacaagaaagccacctacgagccagatgttgacctaggaagcggaacccgcaacattggaattgaaagtgaggtaccaaacctggacataattgggaaaagaatagaaaaaataaaacaagagcatgaaacatcatggcactatgaccaagatcacccatacaaaacgtgggcataccatggtagctacgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagcacgcttcctggagtttgaagccttaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtaccaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaagaacatccagcacctgacagccacagaagaaattgccgtgcaaaactgcttagcaagattggggcgcgaaaggttatcaagaatggccatcagtggagatgattgtgtagtgaaacctttagatgacaggttcgcaagtgctttgacagctctaaatgacatgggaaagattaggaaggacatacaacaatgggaaccttcaagaggatggaatgattggacacaggtgcccttctgttcacaccatttccatgagttaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 7171 - RNA, 9876 nt, synthetic construct
  misc_feature 1..9876: note = derived and/or modified CDS sequence (wt) from DENV-2__AF169681__SS-prME
  source 1..9876: mol_type = other RNA
tctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccttaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacgctgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagaatctcataaccaaacctttctcattgatggccccaagacggcagaatgccccaacacaaatagagcttggaactcgttggaggtcgaagactacggctttggagtgttcaccaccaatatatggctaaaattgaaagaaaaacaggatgcattgtgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaaaaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaagataccttccggccatagtcagagaagctataaaacggggtttgagaacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaatacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggcggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggtgttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggagagacgcttggagagaaatggaaaagccgactgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgtcttcagagtggagttgacgttttcttcatcccgccagaaaagtgtgacacattgttgtgtgacataggggagtcatcaccaaatcccacagtggaagcaggacgaacactcagagtccttaatttagtagaaaattggctgaacaacaacactcaattctgcataaaagttctcaacccatatatgccctcagttatagaaaaaatggaagcactgcaaaggaaatatggaggagccttagtgagaaatccactctcacggaactccacacatgagatgtactgggtatccaatgcttccgggaacatagtgtcatcagtgaacatgatttcaagaatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccttaggattcctaaatgaagatcactggttctccagagagaactccctgagtggagtggaaggagaagggctgcacaagctacgttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtttttaagaacatccagcacctgacagccacagaagaaattgccgtgcaaaactggttagcaagagtggggcgcgaaaggttatcaagaatggccatcagtggagatgattgtgtagtgaaacctttagatgacaggttcgcaagcgctttgacagctctaaacgacatgggaaagattagaaaggacatacaacaatgggaaccttcaagaggatggaacgattggacacaagtgcccttttgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 7172 - RNA, 9876 nt, synthetic construct
  misc_feature 1..9876: note = derived and/or modified CDS sequence (wt) from DENV-2__AF169683__SS-prME
  source 1..9876: mol_type = other RNA
tctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagattgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagttttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcatgcaggaaaacgatctctgcggcctcagcccactgagctaaagtattcatggaaaacatggggcaaagcaaaaatgctctccacagagtctcataaccaaacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaagataccttccggccatagtcagagaagctataaaacggggtttgagaacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactttagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggcggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggtgttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggagagacgcttggagagaaatggaaaagccgactgaacgcactgggaaaaagtgaatcacagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtagtggacctcggttgtggcagaggaggctggtcatactattgtggaggaataaaaaacgtaagagaagtgaaaggcctaacaaaaggaggaccaggacacgaagaacccatccccatgtcaacatatgggtggaatctagtgcgtcttcagagtggagttgacgttttcttcatcccgccagaaaagtgtgacacattgttgtgtgacataggggagtcatcaccaaatcccacagtggaagcaggacgaacactcagagtccttaatttagtagaaaattggctgaacaacaacactcaattctgcataaaagttctcaacccatatatgccctcagttatagaaaaaatggaagcactgcaaaggaaatatggaggagccttagtgagaaatccactctcacggaactccacacatgagatgtactgggtatccaatgcttccgggaacatagtgtcatcagtgaacatgatttcaagaatgttgatcaacagattcacaatgagacacaagaaagccacttatgagccggatgttgacctcggaagcggaacccgtaacattggaattgaaagtgaaataccaaacctagacataattgggaaaagaatagaaaaaataaagcaagagcatgaaacatcatggcattacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccttaggattcctaaatgaagatcactggttctccagagagaactccctgagtggattggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaagaacatccagcacctgacagccacagaagaaattgccgtgcaaaactggttagcaagagtggggcgcgaaaggttatcaagaatggccatcagtggagatgattgtgtagtgaaacctttagatgacaggttcgcaagcgctttgacagctctaaacgacatgggaaagattagaaaggacatacaacaatgggaaccttcaagaggatggaacgattggacacaagtgcccttttgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 7173 - RNA, 9876 nt, synthetic construct
  misc_feature 1..9876: note = derived and/or modified CDS sequence (wt) from DENV-2__AF169684__SS-prME
  source 1..9876: mol_type = other RNA
tctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaagaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaaaataccttccggccatagtcagagaagctataaaacggggtttgagaacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtgatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactttagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgaggggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggcggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatatttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggagagacgcttggagagaaatggaaaagccgactgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtggtggacctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgtcttcagagtggagttgacgttttcttcatcccgccagaaaagtgcgacacattgctgtgtgacataggggagtcgtcaccaaatcccacggtagaggcaggacggacactcagagtcctcaacttagtggaaaattggttgaacaacaacacccaattttgcataaaggttctcaacccatacatgccctcagtcatagaaaaaatggaagcactacaaaggagatatggaggagccttagtgaggaatccactctcacgaaactccacacatgagatgtactgggtatccaatgcctccgggaacatagtgtcatcagtgaacatgatttcaaggatgttgatcaacagattcacaatgaaacacaagaaagccacctacgagccagatgttgacttaggaagcggaacccgcaacattggaattgaaagtgaggtaccaaacctggacataattgggaaaagaatagaaaaaataaaacaagagcatgaaacatcatggcactatgaccaagatcacccatacaaaacatgggcttaccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccttaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaagaacatccagcacctgacagccacagaagaaattgccgtgcaaaactggttagcaagagtggggcgcgaaaggttatcaagaatggccatcagtggagatgattgtgtagtgaaacctttagatgacaggttcgcaagcgctttgacagctctaaacgacatgggaaagattagaaaggacatacaacaatgggaaccttcaagaggatggaacgattggacacaagtgcccttttgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 7174 - RNA, 9876 nt, synthetic construct
  misc_feature 1..9876: note = derived and/or modified CDS sequence (wt) from DENV-2__AF169685__SS-prME
  source 1..9876: mol_type = other RNA
tctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcgaaaatgctctccacagaatctcataaccagacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattgccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtccctaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaagataccttccggccatagtcagagaagctataaaacggggtttgagaactttaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactttagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggaggaagggcgtacaatcatgccctcagtgaattgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggtgttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggagagacgcttggagagaaatggaaaagccgactgaacgcactggggaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgtcttcagagtggagttgacgttttcttcatcccgccagaaaagtgtgacacattgctgtgtgacataggggagtcatcaccaaatcccacggtggaggcaggacggacactcagagtcctcaacttagtggaaaattggttgaacaacaacacccaattctgcataaaggttctcaacccatacatgccctcagtcatagaaaaaatggaagcactacaaaggagatatggaggagccttagtgaggaatccactctcacgaaactccacacatgagatgtactgggtatccaatgcctccgggaacatagtgtcatcagtgaacatgatttcaaggatgttgatcaacagattcacaatgagacacaagaaagccacttacgagccggatgttgacctcggaagcggaacccgcaacattggaattgaaagtgaggtaccaaacctggacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccttaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaagaacatccagcacctgacagccacagaagaaattgccgtgcaaaactggttagcaagagtggggcgcgaaaggttatcaagaatggccatcagtggagatgattgtgtagtgaaacctttagatgacaggttcgcaagcgctttgacagctctaaacgacatgggaaagattagaaaggacatacaacaatgggaaccttcaagaggatggaacgattggacacaagtgcccttttgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 7175 - RNA, 9876 nt, synthetic construct
  misc_feature 1..9876: note = derived and/or modified CDS sequence (wt) from DENV-2__AF169686__SS-prME
  source 1..9876: mol_type = other RNA
tctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcttcataggagtcattatcacatggataggaatgaactcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcaggcaggaaaacgatctctgcggcctcagcccactgagctaaagtattcatggaaaacatggggcaaagcaaaaatgctctccacagagtctcataaccaaacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccagtaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaaaataccttccggccatagtcagagaagctataaaacggggtttgagaacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactttagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgaggggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggcggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggtgttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggagagacgcttggagagaaatggaaaagccgactgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtagtggacctcggttgtggcagaggaggctggtcatactattgtggaggactaaaaaacgtaagagaagtgaaaggcctaacaaaaggaggaccaggacacgaagaacccatccccatgtctacatatgggtggaacctagtgcgtcttcaaagtggagttgacgttttcttcactccgccagaaaagtgcgacacattgctgtgtgacataggggagtcgtcaccaaatcccacggtagaggcaggacggacactcagagtcctcaacttagtggaaaattggttgaacaacaacacccaattttgcataaaggttctcaacccatacatgccctcagtcatagaaaaaatggaagcactacaaaggagatatggaggagccttagtgaggaatccactctcacgaaactccacacatgagatgtactgggtatccaatgcctccgggaacatagtgtcatcagtgaacatgatttcaaggatgttgatcaacagattcacaatgaaacacaagaaagccacctacgagccagatgttgacttaggaagcggaacccgcaacattggaattgaaagtgaggtaccaaacctggacataattgggaaaagaatagaaaaaataaaacaagagcatgaaacatcatggcactatgaccaagatcacccatacaaaacgtgggcttaccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaaaccttaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaagaacatccagcacctgacagccacagaagaaattgccgtgcaaaactggttagcaagagtggggcgcgaaaggttatcaagaatggccatcagtggagatgattgtgtagtgaaacctttagatgacaggttcgcaagcgctttgacagctctaaacgacatgggaaagattagaaaggacatacaacaatgggaaccttcaagaggatggaacgattggacacaagtgcccttttgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctggcagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 7176 - RNA, 9876 nt, synthetic construct
  misc_feature 1..9876: note = derived and/or modified CDS sequence (wt) from DENV-2__AF169687__SS-prME
  source 1..9876: mol_type = other RNA
tctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctatcagaaaatgaggtgaagttaactatcatgacaggagacatcaaaggaatcatgcatgcaggaaaacgatctctgcggcctcagcccactgagctaaagtattcatggaaaacatggggcatagcaaaaatgctctccacagagtctcataaccaaacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttacggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaagataccttccggccatagtcagagaagctataaaacggggtttgagaacattaatcttggcccccaccagagtcgtggcagctgaaatggaggaagctctgagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattttggcaggacccatgccagtgacccactttagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggcggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggtgttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggagagacgcttggagagaaatggaaaagccgactgaacgcactgggaaaaagtgaattccagatatacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtagtggacctcggttctggcagaggaggctggtcatactattgtggaggactaaaaaacgtaagagaagtgaaaggcctaacaaaaggaggaccaggacacgaagaacccatccccatgtcaacatatgggtggaatctagtgcgtcttcagagtggagttgacgttttcttcatcccgccagaaaagtgtgacacattgttgtgtgacataggggagtcatcaccaaatcccacagtggaagcaggacgaacactcagagtccttaatttagtagaaaattggctgaacaacaacactcaattctgcataaaagttctcaacccatatatgccctcagttatagaaaaaatggaagcactgcaaaggaaatatggaggagccttagtgagaaatccactctcacggaactccacacatgagatgtactgggtatccaatgcttccgggaacatagtgtcatcagtgaacatgatttcaagaatgttgatcaacagattcacaatgagacacaagaaagccacttacgagccggatgttgacctcggaagcggaacccgtaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccttaggattcctaaatgaagatcactggttctccagagagaactccctgagtggagtggaaggagaagggtcgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaagaacatccagcacctgacagccacagaagaaattgccgtgcaaaactggttagcaagagtggggcgcgaaaggttatcaagaatggccatcagtggagatgattgtgtagtgaaacctttagatgacaggttcgcaagcgctttgacagctctaaacgacatgggaaagattagaaaggacatacaacaatgggaaccttcaagaggatggaacgattggacacaagtgcccttttgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaaccccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 7177 - RNA, 9876 nt, synthetic construct
  misc_feature 1..9876: note = derived and/or modified CDS sequence (wt) from DENV-2__AF169688__SS-prME
  source 1..9876: mol_type = other RNA
tctgcaggcatgatcattatgctgattccaacagtgatggcgtttcatctaaccacacgtaacggagaaccacacatgatcgtcagtatacaagagaaagggaaaagtcttctgtttaaaacagaggatggcgtgaacatgtgcaccctcatggccatggaccttggtgaattgtgtgaagacacaatcacgtacaagtgtccccttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaagagcatgcggtcggaaatgacacaggaaaacatggcaaggaaatcaaagtaacaccacagagttccatcacagaagcagaattgacaggttatggcaccgtcacgatggagtgctctccgagaacaggcctcgacttcaatgagatggtgttgctgcagatggaaaataaagcttggctggtgcataggcaatggttcctagacctgccattaccatggctgcccggagcggatacacaagggtcaaattggatacagaaagaaacattggtcactttcaaaaatccccatgcgaagaaacaggatgttgttgttttaggttcccaagaaggggccatgcacacagcactcacaggagccacagaaatccaaacgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgtagaatcccttttgagataatggatttggaaaaaagatatgtcttaggccgcctgatcacagtcaacccaattgtgacagaaaaagatagcccagtcaacatagaagcagaacctccatttggagacagctacatcatcataggagtagagccgggacaactgaagctcaactggttcaagaaaggaagttctatcggccaaatgtttgagacaacaatgagaggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaattcacgcagcacctcactgtctgtgtcactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcagtaacaagattggagaacctaatgtggaaacaaataacaccagaattgaatcacattctagcagaaaatgaggtgaagttaactatcatgacaggagacatcaaaggaatcatgcatgcaggaaaacgatctctgcggcctcagcccactgagctaaagtattcatggaaaacatggggcaaagcaaaaatgctctccacagagtctcataaccaaacctttctcattgatggccccgaaacggcagaatgccccaacacaaatagagcttggaactcgttggaggtcgaagactacggctttggagtgttcaccaccaatatatggctaaaattgaaagaaaaacaggatgcattctgcgactcaaaactcatgtcagcggccataaaagacaacagagccgtccatgccgacatgggttactggatagaaagtgcactcaatgacacatggaagatagagaaagcctctttcattgaagtgaaaaattgccactggccaaaatcacacaccctctggagcaatggagtgctagaaagtgagatgataattccaaagaatctcgctggaccagtgtctcaacacaactatagaccaggctaccatacacaaatagcaggaccatggcatctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatgacggatgacataggtatgggcgtgacttatcttgccctactagcagccttcaaagttagaccaacttttgcagctggactacttttgagaaagctgacctccaaggaattgatgatgactaccataggaattgtactcctctcccaaagcactataccagagaccattcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgattttgacatcctcacagcaaaaaacggattggataccattagcattgacaatcaaaggtctcaatccaacagccatttttctaacaaccctctcaagaaccaacaagaaaaggagctggccactaaatgaagctatcatggcagtcggaatggtgagcattttggccagttctctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacctatgggaaaggctgaactggaagacggagcctacagaatcaagcaaaaagggattcttggatattcccagatcggagctggagtttataaagaaggaacattccatacaatgtggcatgtcacacgtggcgctgtcctaatgcataaaggaaagaggattgaaccatcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtctattcaaaaccaacaccggaacaataggtgccgtatctctggacttttcccctggaacgtcaggatctccaatcattgacaaaaaaggaaaagttgtgggtctttatggtaatggtgttgttacaaggagtggagcatatgtgagtgcaatagcccaaactgaaaaaagcattgaagacaacccagagatcgaagatgacattttccgaaagagaagactgaccatcatggacctccacccaggggcgggaaagacgaaaagataccttccggccatagtcagagaagctataaaacggggtttgagaacattaatcttggcccccaccagagtcgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacctgatcatcatggacgaagcccatttcacagacccagcaagtatagcagctagaggatacatctcaactcgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggacttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactttagtgcagcacaaagaagagggagaataggaagaaatccaaaaaatgaaaatgaccagtacatatacatgggggaacctctggaaaatgatgaagactgtgcacactggaaagaagccaaaatgctcctagataacatcaacacaccagaaggaatcattcccagtatgtttgaaccagagcgtgaaaaagtggatgccattgatggcgaataccgcttgagaggagaagcaaggaaaacctttgtggacttaatgagaagaggagacctaccagtctggttggcctacaaagtggcagctgaaggcatcaactatgcagacagaaggtggtgttttgatggaattaagaacaaccaaatcctggaagaaaatgtggaagttgagatctggacaaaagaaggggaaagaaagaaattgaaacccagatggctggacgctaggatctattctgacccactggcgctaaaagaattcaaagaatttgcagccggaagaaagtctctggccctgaacctaatcacagaaatgggtaggcttccgacattcatgactcagaagacaagagacgcactggacaacttagcagttctgcacacggctgaagcaggaggaagggcgtacaatcatgccctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggtgttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaagatcttggatttggaagtattgcaacccagcaacccgagagcaacatcctggacatagatctacgtcccgcatcagcttggacgctgtatgccgtggctacaacatttgttacaccaatgctgagacatagcattgagaattcctcagtgaatgtgtccctaacagctatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccatcatagggccaggacttcaagcaaaagcaaccagagaagctcagaaaagagcagcggcgggtattatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcctatctccacactgtgggaaggaaatccaggaaggttctggaacactaccattgcggtgtcaatggctaatatctttagagggagttacttggctggagctggacttctcttttccattatgaagaacacaaccaacacaagaaggggaactggcaacataggaaagacgcttggagagaaatggaaaagccgactgaacgcactgggaaaaattgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggttacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcaacatatgggtggaatctagtgcgtcttcagagtggagttgacgttttcttcatcccgccagaaaagtgtgacacattgttgtgtgacataggggagtcatcaccaaatcccacagtggaagcaggacgaacactcagagtccttaatttagtagaaaattggctgaacaacaacactcaattctgcataaaagttctcaacccatatatgccctcagttatagaaaaaatggaagcactgcaaaggaaatatggaggagccttagtgagaaatccactctcacggaactccacacatgagatgtactgggtatccaatgcttccgggaacatagtgtcatcagtgaacatgatttcaagaatgttgatcaacagattcacaatgagacacaagaaagccacttacgagccggatgttgacctcggaagcgggacccgtaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggagccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccttaggattcctaaatgaagatcactggttctccagagagaactccctgagtggagtggaaggagaagggctgcacaagctaggttacattctaagagacgtgagcaagaaagagggaggagccatgtatgccgatgacacagcaggatgggacacaagaatcacactagaagacctaaaaaatgaagaaatggtaacaaaccacatggaaggagaacacaagaaattagccgaggccattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaagaacatccagcacctgacagccacagaagaaattgccgtgcaaaactggttagcaagagtggggcgcgaaaggttatcaagaatggccatcagtggagatgattgtgtagtgaaacctttagatgacaggttcgcaagcgctttgacagctctaaacgacatgggaaagattagaaaggacatacaacaatgggaaccttcaagaggatggaacgattggacacaagtgcccttttgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacagacgcgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacatgggcaaagaacatccaagcagcaataaatcaagttagatctcttataggcaatgaggaatacacagattacatgccatccatgaaaagattcagaagagaagaggaagaagcaggagtcctgtggtag

SEQ ID NO: 7178 - RNA, 9873 nt, synthetic construct
  misc_feature 1..9873: note = derived and/or modified CDS sequence (wt) from DENV-3__AB189125__SS-prME
  source 1..9873: mol_type = other RNA
acatcgctctgtctcatgatgatgttaccagcaacacttgctttccacttgacttcacgagatggagagccgcgcatgattgtggggaagaatgaaagaggaaaatccctactttttaagacagcctctggaatcaacatgtgcacactcatagccatggatttgggagaaatgtgtgatgacacggtcacttacaagtgccccctcattactgaagtggagcctgaagacattgactgctggtgcaacctcacatcgacgtgggtgacctacggaacgtgcaaccaagctggagagcatagacgcgataagagatcggtggcgttagctcctcatgtcggcatgggactggacacacgcgcccaaacctggatgtcggctgaaggagcttggagacaagtcgagaaggtagagacatgggcctttaggcacccagggttcacgatactagccctatttcttgcccattacataggcacttccttgacccagaaagtggtcattttcatactactaatgctggtcaccccatccatgacaatgagatgtgtgggagtaggaaacagagattttgtggaaggcctatcaggagctacgtgggttgacgtggtgctcgaacacggtgggtgcgtgactaccatggctaagaacaagcccacgctggacatagagctccagaagaccgaggccacccaactggcaaccctaaggaaactatgcattgagggaaaaatcaccaacgtgacaaccgactcaaggtgccccacccaaggggaagcgattctacctgaggagcaggaccagaactacgtgtgtaagcacacatacgtggacagaggctggggaaacggttgtggtttgtttggcaagggaagcttggtaacatgcgcaaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaactgtcgaagccatcttacctgaatatggaacccttgggctagaatgctcaccacggacaggtttggatttcaatgaaatgattttgttgacaatgaagaacaaagcatggatggtacatagacaatggttttttgacctacctctaccatggacatcaggggctacaacagaaacaccaacctggaataagaaagagcttcttgtgacattcaaaaacgcacacgcaaaaaaacaagaagtagtagtccttggatcgcaagagggagcaatgcacacagcactgacaggagctacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggtcgagtacaaaggggaagacgcaccttgcaagattcctttctccacggaggatggacaagggaaagcccacaatggcagactgatcacagctaacccagtggtgaccaagaaggaggagcctgtcaatattgaggcagaacctccttttggggaaagtaacataataattggaattggagacaaagccctgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggccctttttagtggagtctcctggataatgaaaattggaataggtgtccttttaacttggatagggttgaattcaaaaaacacttctatgtcattttcatgcattgtgataggaatcatcacactctatctgggagccgtggtgcaagctgacatggggtgtgtcataaactggaaaggcaaagaactcaaatgtggaagtggaatttttgttactaatgaggtccacacctggacagagcaatacaaatttcaagcagactcccccaaaagactggcgacagccattgcaggcgcctgggagaatggagtgtgcggaatcaggtcgacaaccagaatggagaacctcttgtggaagcaaatagccaatgaactaaactacatattatgggaaaacaacatcaaattaacggtagttgtgggtgatataattgggatcttagagcaagggaaaagaacactaacaccacaacccatggagctaaaatattcatggaaaacatggggaaaggcgaaaatagtgacagctgaaatacaaaattcctcctttataatagatgggccaaacacaccagagtgtccaaatgcctcaagagcatggaatgtgtgggaggtggaagattacgggttcggagtcttcacaactaatatatggctgaaactccgagaaatgtacacccaactatgtgaccacaggctaatgtcggcagccgttaaggatgagagagccgtacacgccgacatgggctattggatagaaagccaaaagaatggtagttggaagctagaaaaggcatctctcatagaggtgaaaacctgcacatggccaaaatcacacactctctggagcaatggtgtgttggagagtgacatgatcatcccaaagagtctggctggtcctatctcgcaacacaattacaggcccggataccacacccaaacggcaggaccatggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacacttcctcccctgcgatatatgggagaagacggctgctggtatggcatggaaattagacccattaatgagaaagaagagaacatggtaaagtctctagtctcagcagggagtggaaaggtggataacttcacaatgggtgtcttgtgtcttgcaatcctctttgaagaggtaatgagaggaaaattcgggaaaaagcacatgattgcaggggttctcttcacatttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcctgaggaaactgacatctagagaaaatttattattgggagttgggttggccatggcaacaacgttgcaactgccagaggacattgaacaaatggcgaatggaatagccttggggctcatggctcttaaattgataacacaatttgaaacataccaactatggacggcattggtctccctaatgtgttcaaacacaattttcacgttgactgttgcctggagaacagccaccctgattttggccggaatttcgcttttgccagtgtgccagtcttcgagcatgaggaaaacagattggctcccaatgactgtggcagctatgggagttccacctctaccactttttattttcagtttgaaagacacactcaaaaggagaagctggccactgaatgagggggtgatggccgttggacttgtgagcattctggcaagttctctccttaggaatgacgtacccatggctggaccattagtggctgggggcttgctgatagcgtgctacgtcataactggcacgtcagcagacctcactgtagaaaaagcagcagatgtgacatgggaagaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatttttccatactccatacctgcaacacttttggtctggcacacttggcaaaagcaaacccaaagatccggcgtcctgtgggacgtacccagccccccagagacacagaaagcagaactggaagaaggggtctataggatcaagcagcaaggaatttttggaaagacccaagtgggggttggagtacaaaaagaaggagttttccacactatgtggcacgtcacaagaggagcagtgttgacatacaatggaaaaagactggaaccaagctgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagctatagttagagaggcaatcaagagacgcttaaggactctaattttggcaccaacaagggtggttgcagctgagatggaagaagcattgaaagggctcccaataaggtatcaaacaactgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtacatatcaactcgtgtaggaatgggagaggcagccgcaattttcatgacagccacacctcctggaacagctgatgcctttcctcagagcaacgctccaattcaagatgaagaaagagacataccagaacgctcatggaattcaggcaatgattggattaccgactttgccggaaagactgtgtggtttgtccccagcatcaaagctgggaatgacatagcaaactgcttgcggaaaaatggaaaaaaggtcattcaacttagtaggaaaacttttgacacagaatatcaaaagactaaactaaatgattgggactttgtggtgacaacagacatttcagaaatgggagccaatttcaaagcagacagagtgatcgacccaagaagatgtctcaagccagtcattttgacagacggacccgagcgcgtgatcctggcaggaccaatgccagtcaccgtagcgagtgctgcgcaaaggagagggagagttggcaggaacccacaaaaagaaaatgaccaatacatattcacgggccagcctctcaacaatgatgaagaccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggagaatgtggatgtggaaatctggacaaaggaaggagaaaagaaaaaattgaggcctaggtggcttgatgcccgcacttattcagatcccttagcgctcaaggaattcaaggactttgcggctggtagaaagtcgatcgcccttgatcttgtgacagaaataggaagagtgccttcacatttagctcacagaacgagaaacgctctggacaatctggtgatgttgcacacgtcagaacacggtgggagggcctacaggcatgcagtggaggaattaccagaaacaatggaaacactcttactcctgggactcatgatcctgttaacaggtggggtgatgcttttcttgatatcaggcaaaggggttggaaagacttcaataggactcatttgtgtagttgcttctagcggcatgttatggatggctgatatcccactccaatggatcgcgtcggccatagttctggagttttttatgatggtgctacttataccagaaccagaaaagcagagaactccccaagacaatcaactcgcatatgtcgtgataggcatacttacattggctgcaatagtagcagccaatgaaatgggattgttggaaaccacaaagagagatttggggatgtccaaagaaccaggtgttgtttcgccaaccagctatttggatgtggatttgcacccagcatcagcctggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcactgggttgctattcacaagtgaacccactaactctcacagcggcagtactcctgctagtcacgcattatgctatcataggtccaggattgcaggcaaaagccactcgtgaagctcaaaaaaggacggctgctggaataatgaagaatccaacggtggatgggataatgacaatagacctagatcctgtaatatacgactcaaaatttgaaaaacaactaggacaagttatgctcctggttctgtgtgcagttcaacttttgttaatgagaacatcatgggcattttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaactttgggagaaaagtggaaaaagaaattgaatcaattatcccggaaagagtttgacctctacaagaaatctggaatcactgaagtggatagaacagaagccaaagaagggttgaaaagaggagaaataacacaccatgccgtatccagaggcagcgcaaaacttcaatggttcgtggagagaaacatggtcattcctgaaggaagagtcatagacttgggctgtggaagaggaggctggtcatattattgtgcaggattgaaaaaagttacagaagtgcgaggatacacaaaaggcggcccaggacatgaagaaccagtacctatgtctacgtatggatggaacatagtcaagctgatgagtggaaaggatgtgttttaccttccacctgaaaagtgtgacactctattgtgtgacattggagaatcttcaccaagcccaacagtggaagagagcagaaccataagagtcttgaaaatggttgaaccatggctaaaaaataaccagttttgcattaaagtattgaacccttacatgccagctgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacatataggagacccaccatagagaaagatgtggatttaggagcggggacccgacatgtcaatgcggaaccagaaacacccaacatggacgtcattggggaaagaataagaaggatcaaggaggagcatagttcaacatggcactatgatgatgaaaatccttacaaaacgtgggcttaccatggatcttatgaggtcaaggccacaggctcagcctcctccatgataaatggagtcgtgaaactcctcacgaaaccatgggatgtggtgcccacggtgacacagatggcaatgacggacacaaccccttttggccagcaaagggtttttaaagagaaagtggacaccaggacacccaaacccatgccaggaacaagaaaggttatggagatcacagcggaatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaattcttacagtggagtagaaggggaaggactgcataagctgggatacatcttgagagatatttccaagatacccggaggagctatgtatgctgatgacacagctggatgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattacacaatggttggaaaccaaaggagtggagaggttaaaaagaatggccatcagcggggatgattgcgtggtgaaaccaatcgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtagtcccctgcagatctcaggatgaattaatagggagagcgagaatctctcagggagcaggatggagccttaaagaaactgcatgcctagggaaagcctacgcccaaatgtgggctctcatgtattttcacagaagagatcttagactagcatccaatgccatatgttcagcagtaccagtccattgggtccccacaagcagaacgacgtggtccatccatgctcaccatcagtggatgactacagaagacatgcttactgtttggaacagggtgtggatagaggacaatccatggatggaagacaaaactccagtcacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccttcgatgaagagattcaggaaggaggaggagtcagagggagccatttggtaa

SEQ ID NO: 7179 - RNA, 9873 nt, synthetic construct
  misc_feature 1..9873: note = derived and/or modified CDS sequence (wt) from DENV-3__AB189126__SS-prME
  source 1..9873: mol_type = other RNA
acatcgctctgtctcatgatgatgttaccagcaacacttgctttccacttgacttcacgagatggagagccgcgcatgattgtggggaagaatgaaagaggaaaatccctactttttaagacagcctctggaatcaacatgtgcacactcatagccatggatttgggagaaatgtgtgatgacacggtcacttacaaatgccccctcattactgaagtggagcctgaagacattgactgctggtgcaacctcacatcgacgtgggtgacctacggaacgtgcaaccaagctggagagcatagacgcgataagagatcggtggcgttagctcctcatgtcggcatgggactggacacacgcgcccaaacctggatgtcagctgaaggagcttggagacaagtcgagaaggtagagacatgggcctttaggcacccagggttcacaatactagccctatttcttgcccattacataggcacttccttgacccagaaagtggtcattttcatactactaatgctggtcaccccatccatgacaatgagatgtgtgggagtaggaaacagagattttgtggaaggcctatcaggagccacgtgggttgacgtggtgctcgaacacggtgggtgtgtgactaccatggctaagaacaagcccacgctggacatagagctccagaagaccgaggccacccaactggcaaccctaaggaaactatgcattgagggaaaaatcaccaacgtgacaaccgactcaaggtgccccacccaaggggaagcgattctacctgaggagcaggaccagaactacgtgtgtaagcacacatatgtggacagaggctggggaaacggttgtggtttgtttggcaagggaagcttggtaacatgcgcgaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccatcttacctgaatatggaacccttgggctagaatgctcaccacggacaggtttggatttcaatgaaatgattttgttgacaatgaagaacaaagcatggatggtacatagacaatggttttttgacctacctctaccatggacatcaggggctacaacagaaacaccaacctggaataagaaagagcttcttgtgacattcaaaaatgcacacgcaaaaaaacaagaagtagtagtccttggatcgcaagagggagcaatgcacacagcactgacaggagctacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggttgagtacaaaggggaagacgcaccttgcaagattcccttctccacggaggatggacaagggaaagcccacaatggcagactgatcacagctaacccagtggtgaccaagaaggaggagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggccctttttagtggagtctcctggataatgaaaattggaataggtgtccttttaacttggatagggttgaattcaaaaaacacttctatgtcattttcatgcattgtgataggaatcatcacactctatctgggagccgtggtgcaagctgacatggggtgtgtcataaactggaaaggcaaagaactcaaatgtggaagtggaattttcgttactaatgaggtccacacctggacagagcaatacaaatttcaagcagactcccccaaaagactggcgacagccattgcaggcgcctgggagaatggagtgtgcggaatcaggtcgacaaccagaatggagaacctcttgtggaagcaaatagccaatgaactaaactacatattatgggaaaacaacatcaaattaacggtagttgtgggtgatataattggggtcttagagcaagggaaaagaacactaacaccacaacccatggagctaaaatattcatggaaaacatggggaaaggcgaaagtagtgacagctgaaatacaaaattcctcctttataatagatgggccaaacacaccagagtgtccaaacgcctcaagagcatggaacgtgtgggaggtggaagattacgggttcggagtcttcacaactaatatatggttgaaactccgagagatgtacacccaactatgtgaccacaggctaatgtcggcagccgttaaggatgagagagccgtacacgccgacatgggctattggatagaaagccaaaagaatggtagttggaagctagaaaaggcatctctcatagaggtgaaaacctgcacatggccaaaatcacacactctctggagcaatggtgtgttggagagtgacatgatcatcccaaagagtctggctggtcctatctcgcaacacaactacaggcccggataccacacccaaacggcaggaccctggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacacttcctcccctgcgatatatgggagaagacggctgctggtatggcatggaaattagacccattaatgagaaagaagagaacatggtaaagtctttagtctcagcagggagtggaaaggtggataacttcacaatgggtgtcttgtgtcttgcaattctctttgaagaggtaatgagaggaaaattcgggaaaaagcacatgattgcagggattctcttcatatttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcctgaggaaactgacatctagagaaaatttattattgggagttgggttggccatggcaacaacgttgcaactgccagaggacattgaacaaatggcgaatggaatagccttggggctcatggctcttaaattgataacacaatttgaaacataccaactatggacggcattagtctccctaacgtgttcaaacacaattttcacgttgactgttgcctggagaacagccaccctgattttggccggaatttcgcttttgccagtgtgccagtcttcgagcatgaggaaaacagattggctcccaatgactgtggcagctatgggagttccacctctaccactttttattttcagtttgaaagacacactcaaaaggagaagctggccactgaatgagggggtgatggccgttggacttgtgagcattctagcaagttctctccttaggaatgacgtacccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatttttccatactccatacctgcaacacttttggtctggcacacttggcaaaagcaaacccaaagatccggcgtcctgtgggacgtacccagccccccagagacacagaaagcagaactggaagaaggggtctataggatcaagcagcaaggaatttttggaaagacccaagtgggtgttggagtacaaaaagaaggagttttccacactatgtggcacgtcacaagaggagcagtgttgacatacaatggaaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagctatagttagagaggcaatcaagagacgcttaaggactctaattttggcaccaacaagggtggttgcagctgagatggaagaagcattgaaagggctcccaataaggtatcaaacaactgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtacatatcaactcgtgtaggaatgggagaggcagccgcaattttcatgacagccacacctcctggaacagctgatgcctttcctcagagcaacgctccaattcaagatgaagaaagagacataccagaacgctcatggaattcaggcaatgattggattaccgactttgccggaaagactgtgtggtttgtccccagcatcaaagctggaaatgacatagcaaactgcttgcggaaaaatggaaaaaaggttattcaacttagtaggaaaacttttgacacagaatatcaaaagactaaactaaatgattgggactttgtggtgacaacagacatttcagaaatgggagccaatttcaaagcagacagagtgatcgacccaagaagatgtctcaagccagtcattttgacagacggacccgagcgcgtgatcctggcgggaccaatgccagtcaccgtagcgagtgctgcgcaaaggagagggagagttggcaggaacccacaaaaagaaaatgaccaatacatattcacgggccagcccctcaacaatgatgaagaccatgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggagaatatggatgtggaaatctggacaaaggaaggagaaaagaaaaaattgaggcctaggtggcttgatgcccgcacttattcagatcccttagcgctcaaggaattcaaggactttgcggctggtagaaagtcgatcgcccttgatcttgtgacagaaataggaagagtgccttcacatttagctcacagaacgagaaacgctctggacaatctggtgatgttgcacacgtcagaacacggtgggagggcctacaggcatgcagtggaggaattaccagaaacaatggaaacactcttactcctgggactcatgatcctgttaacaggtggggcgatgcttttcttgatatcaggcaaaggggttggaaagacttcaataggactcatttgtgtagttgcttccagcggcatgttatggatggctgacatcccactccaatggatcgcgtcggccatagttctggagttttttatgatggtgctacttataccagaaccagaaaaacagagaactccccaagacaatcaactcgcatatgtcgtgataggcatacttacattggctgcaatagtagcagccaatgaaatgggattgttggaaaccacaaagagagatttggggatgtccaaagaaccaggagttgttccgccaaccagctatttggatgtggatttgcacccagcatcagcctggacattgtatgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcactgggttgctattcacaagtgaacccactaactctcacagcggcagtactcctgctggtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttgatgagaacatcatgggcattttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaactttgggagaaaagtggaaaaagaaattgaatcaattatcccggaaagagtttgacctctacaagaaatccggaatcactgaagtggatagaacagaagccaaagaagggttgaaaagaggagaaataacacaccatgccgtatctagaggcagcgcaaaacttcaatggttcgtggagagaaacatggtcattcctgaaggaagggtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctgatgagtggaaaggatgtgttttatcttccacctgaaaagtgtgacactctattgtgtgacattggagaatcttcaccaagcccaacagtggaagagagcagaaccataagagtcttgaaaatggttgaaccatggctaaaaaataaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttacaaaacgtgggcctaccatggatcttatgaagttaaggccacaggctcagcctcctccatgataaatggagtcgtgaaactcctcacgaaaccatgggatgtggtgcccacggtgacacagatggcaatgacggacacaaccccttttggccagcaaagggtttttaaagagaaagtggacaccaggacacccaaacccatgccaggaacaagaaaggttatggagatcacagcggaatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagctatgtatgctgatgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattacacaatggttggaaaccaaaggagtggagaggttaaaaagaatggccatcagcggggatgattgcgtggtgaaaccaatcgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtagtcccctgcagacctcaggatgaattaatagggagagcgagaatctctcagggagcaggatggagccttaaagaaactgcatgcctagggaaagcctacgcccaaatgtgggctctcatgtattttcacagaagagatcttagactagcatccaacgccatatgttcagcagtaccagtccattgggtccccacaagcagaacgacgtggtccatccatgctcaccatcagtggatgactacagaagacatgcttactgtttggaacagggtgtggatagaggacaatccatggatggaagacaagactccagtcacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccttcgatgaagagattcaggaaggaggaggagttagagggagccatttggtaa

SEQ ID NO: 7180 - RNA, 9873 nt, synthetic construct
  misc_feature 1..9873: note = derived and/or modified CDS sequence (wt) from DENV-3__AB189127__SS-prME
  source 1..9873: mol_type = other RNA
acatcgctctgtctcatgatgatgttaccagcaacacttgctttccacttgacttcacgagatggagagccgcgcatgattgtggggaagaatgaaagaggaaaatccctactttttaagacagcctctggaatcaacatgtgcacactcatagccatggatttgggagaaatgtgtgatgacacggtcacttacaaatgccccctcattactgaagtggagcctgaagacattgactgctggtgcaacctcacatcgacgtgggtgacctacggaacgtgcaaccaagctggagagcatagacgcgataagagatcggtggcgttagctcctcatgtcggcatgggactggacacacgcgcccaaacctggatgtcagctgaaggagcttggagacaagtcgagaaggtagagacatgggcctttaggcacccagggttcacaatactagccctatttcttgcccattacataggcacttccttgacccagaaagtggtcattttcatactactaatgctggtcaccccatccatgacaatgagatgtgtgggagtaggaaacagagattttgtggaaggcctatcaggagccacgtgggttgacgtggtgctcgaacacggtgggtgtgtgactaccatggctaagaacaagcccacgctggacatagagctccagaagaccgaggccacccaactggcaaccctaaggaaactatgcattgagggaaaaatcaccaacgtgacaaccgactcaaggtgccccacccaaggggaagcgattctacctgaggagcaggaccagaactacgtgtgtaagcacacatatgtggacagaggctggggaaacggttgtggtttgtttggcaagggaagcttggtaacatgcgcgaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccatcttacctgaatatggaacccttgggctagaatgctcaccacggacaggtttggatttcaatgaaatgattttgttgacaatgaagaacaaagcatggatggtacatagacaatggttttttgacctacctctaccatggacatcaggggctacaacagaaacaccaacctggaataagaaagagcttcttgtgacattcaaaaatgcacacgcaaaaaaacaagaagtagtagtccttggatcgcaagagggagcaatgcacacagcactgacaggagctacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggttgagtacaaaggggaagacgcaccttgcaagattcccttctccacggaggatggacaagggaaagcccacaatggcagactgatcacagctaacccagtggtgaccaagaaggaggagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggccctttttagtggagtctcctggataatgaaaattggaataggtgtccttttaacttggatagggttgaattcaaaaaacacttctatgtcattttcgtgcattgtgataggaatcatcacactctatctgggagccgtggtgcaagctgacatggggtgtgtcataaactggaaaggcaaagaactcaaatgtggaagtggaattttcgttactaatgaggtccacacctggacagagcaatacaaatttcaagcagactcccccaaaagactggcgacagccattgcaggcgcctgggagaatggagtgtgcggaatcaggtcgacaaccagaatggagaacctcttgtggaagcaaatagccaatgaactaaactacatattatgggaaaacaacatcaaattaacggtagttgtgggtgatataattggggtcttagagcaagggaaaagaacactaacaccacaacccatggagctaaaatattcatggaaaacatggggaaaggcgaaagtagtgacagctgaaatacaaaattcctcctttataatagatgggccaaacacaccagagtgtccaaacgcctcaagagcatggaacgtgtgggaggtggaagattacgggttcggagtcttcacaactaatatatggttgaaactccgagagatgtacacccaactatgtgaccacaggctaatgtcggcagccgttaaggatgagagagccatacacgccgacatgggctattggatagaaagccaaaagaatggtagttggaagctagaaaaggcatctctcatagaggtgaaaacctgcacatggccaaaatcacacactctctggagcaatggtgtgttggagagtgacatgatcatcccaaagagtctggctggtcctatctcgcaacacaactacaggcccggataccacacccaaacggcaggaccctggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacacttcctcccctgcgatatatgggagaagacggctgctggtatggcatggaaattagacccattaatgagaaagaagagaacatggtaaagtctttagtctcagcagggagtggaaaggtggataacttcacaatgggtgtcttgtgtcttgcaattctctttgaagaggtaatgagaggaaaattcgggaaaaagcacatgattgcagggattctcttcatgtttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcctgaggaaactgacatctagagaaaatttattattgggagttgggttggccatggcaacaacgttgcaactgccagaggacattgaacaaatggcgaatggaatagccttggggctcatggctcttaaattgataacacaatttgaaacataccaactatggacggcattagtctccctaacgtgttcaaacacaattttcacgttgactgttgcctggagaacagccaccctgattttggccggaatttcgcttttgccagtgtgccagtcttcgagcatgaggaaaacagattggctcccaatgactgtggcagctatgggagttccacctctaccactttttattttcagtttgaaagacacactcaaaaggagaagctggccactgaatgagggggtgatggccgttggacttgtgagcattctagcaagttctctccttaggaatgacgtacccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatttttccatactccatacctgcaacacttttggtctggcacacttggcaaaagcaaacccaaagatccggcgtcctgtgggacgtacccagccccccagagacacagaaagcagaactggaagaaggggtctataggatcaagcagcaaggaatttttggaaagacccaagtgggtgttggagtacaaaaagaaggagttttccacactatgtggcacgtcacaagaggagcagtgttgacatacaatggaaaaagactggaaccaagctgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagctatagttagagaggcaatcaagagacgcttaaggactctaattttggcaccaacaagggtggttgcagctgagatggaagaagcattgaaagggctcccaataaggtatcaaacaactgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtacatatcaactcgtgtaggaatgggagaggcagccgcaattttcatgacagccacacctcctggaacagctgatgcctttcctcagagcaacgctccaattcaagatgaagaaagagacataccagaacgctcatggaattcaggcaatgattggattaccgactttgccggaaagactgtgtggtttgtccccagcatcaaagctggaaatgacatagcaaactgcttgcggaaaaatggaaaaaaggttattcaacttagtaggaaaacttttgacacagaatatcaaaagactaaactaaatgattgggactttgtggtgacaacagacatttcagaaatgggagccaatttcaaagcagacagagtgatcgacccaagaagatgtctcaagccagtcattttgacagacggacccgagcgcgtgatcctggcgggaccaatgccagtcaccgtagcgagtgctgcgcaaaggagagggagagttggcaggaacccacaaaaagaaaatgaccaatacatattcacgggccagcccctcaacaatgatgaagaccatgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggagaatatggatgtggaaatctggacaaaggaaggagaaaagaaaaaattgaggcctaggtggcttgatgcccgcacttattcagatcccttagcgctcaaggaattcaaggactttgcggctggtagaaagtcgatcgcccttgatcttgtgacagaaataggaagagtgccttcacatttagctcacagaacgagaaacgctctggacaatctggtgatgttgcacacgtcagaacacggtgggagggcctacaggcatgcagtggaggaattaccagaaacaatggaaacactcttactcctgggactcatgatcctgttaacaggtggggcgatgcttttcttgatatcaggcaaaggggttggaaagacttcaataggactcatttgtgtagttgcttccagcggcatgttatggatggctgacatcccactccaatggatcgcgtcggccatagttctggagttttttatgatggtgctacttataccagaaccagaaaaacagagaactccccaagacaatcaactcgcatatgtcgtgataggcatacttacattggctgcaatagtagcagccaatgaaatgggattgttggaaaccacaaagagagatttggggatgtccaaagaaccaggagttgttccgccaaccagctatttggatgtggatttgcacccagcatcagcctggacattgtatgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcactgggttgctattcacaagtgaacccactaactctcacagcggcagtactcctgctggtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttgatgagaacatcatgggcattttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaactttgggagaaaagtggaaaaagaaattgaatcaattatcccggaaagagtttgacctctacaagaaatccggaatcactgaagtggatagaacagaagccaaagaagggttgaaaagaggagaaataacacaccatgccgtatctagaggcagcgcaaaacttcaatggttcgtggagagaaacatggtcattcctgaaggaagggtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctgatgagtggaaaggatgtgttttatcttccacctgaaaagtgtgacactctattgtgtgacattggagaatcttcaccaagcccaacagtggaagagagcagaaccataagagtcttgaaaatggttgaaccatggctaaaaaataaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttacaaaacgtgggcctaccatggatcttatgaagttaaggccacaggctcagcctcctccatgataaatggagtcgtgaaactcctcacgaaaccatgggatgtggtgcccacggtgacacagatggcaatgacggacacaaccccttttggccagcaaagggtttttaaagagaaagtggacaccaggacacccaaacccatgccaggaacaagaaaggttatggagatcacagcggaatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagctatgtatgctgatgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattacacaatggttggaaaccaaaggagtggagaggttaaaaagaatggccatcagcggggatgattgcgtggtgaaaccaatcgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtagtcccctgcagacctcaggatgaattaatagggagagcgagaatctctcagggagcaggatggagccttaaagaaactgcatgcctagggaaagcctacgcccaaatgtgggctctcatgtattttcacagaagagatcttagactagcatccaacgccatatgttcagcagtaccagtccattgggtccccacaagcagaacgacgtggtccatccatgctcaccatcagtggatgactacagaagacatgcttactgtttggaacagggtgtggatagaggacaatccatggatggaagacaagactccagtcacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccttcgatgaagagattcaggaaggaggaggagttagagggagccatttggtaa

SEQ ID NO: 7181 - RNA, 9873 nt, synthetic construct
  misc_feature 1..9873: note = derived and/or modified CDS sequence (wt) from DENV-3__AB189128__SS-prME
  source 1..9873: mol_type = other RNA
acatcgctctgtctcatgatgatattaccagcaacacttgctttccacttgacttcacgagatggagagccgcgcatgattgtggggaagaatgaaagaggaaaatccctactttttaagacagcctctggaatcaacatgtgcacactcatagccatggatttgggagagatgtgtgatgacacggtcacttacaaatgccccctcattactgaagtggagcctgaagacattgactgttggtgcaacctcacatcgacgtgggtgacctatggaacgtgcaaccaagctggagagcacagacgcgataagagatcggtggcgttagctccccatgtcggcatgggactggacacacgcacccaaacctggatgtcggctgaaggagcctggagacaagtcgagaaggtagagacatgggcctttaggcacccagggtttacagtactagccctatttcttgcccatttcataggcacttccttgacccagaaagtggtcattttcatactactaatgctggtcaccccatccatgacaatgagatgtgtgggagtagggaacagagattttgtggaaggcctatcaggagctacgtgggttgacgtggtgcttgaacatggtgggtgtgtaactaccatggctaagaacaagcccacgctggacatagagctccagaagaccgaagccacccaactggcgaccctaaggaaactatgcatcgagggaaaaatcaccaacgtaacaaccgactcaaggtgccccacccaaggagaagcgattttacctgaggaacaggaccagaactacgtgtgtaagcacacatacgtggacagaggctggggaaacggttgtggtttgtttggcaagggaagcttggtaacatgcgcgaaatttcaatgtttggaatcaatagagggaaaagtggtgcagcatgagaacctcaaatacaccgtcatcatcacagtgcatacaggagaccaacaccaggtgggaaatgaaacgcagggagtcacggctgagataacaccccaggcatcaaccgtcgaagccatcttacctgaatatggaacccttgggctagaatgctcaccacggacaggtttggatttcaatgaaatgattttgttgacaatgaagaacaaagcatggatggtacatagacaatggttttttgacctacctctaccatggacatcaggggctacaacagaaacaccaacctggaataagaaagagcttcttgtgacattcaaaaacgcacatgcaaaaaaacaagaagtagtagtccttggatcgcaagagggagcaatgcacacagcactgacaggagctacagagatccaaacctcaggaggcacaagtatttttgcggggcacttaaaatgcagactcaagatggacaaattggaactcaaggggatgagctatgcaatgtgtttaaatgcctttgtgttgaagaaagaagtctccgaaacacaacatgggacaatactcattaaggttgagtacaaaggggaagatgcaccctgcaagattcctttctccacggaggatggacaagggaaagcccacaatggcagactgatcacagccaacccagtggtgaccaagaaggaggagcctgtcaatattgaggcagaacctccttttggggaaagtaatatagtaattggaattggagacaaagccttgaaaatcaactggtataagaagggaagctcgattgggaaaatgttcgaggccactgccagaggtgcaaggcgcatggccatcttgggagacacagcctgggactttggatcagtaggtggtgttttaaattcattagggaaaatggtgcaccaaatatttggaagtgcttacacggccctatttagtggagtctcctggataatgaaaattggaataggtgtccttttaacctggatagggttgaattcaaaaaacacttctatgtcattttcatgcattgtgataggaatcatcacactctatctgggagccgtggtgcaagctgacacggggtgtgttataaactggaaaggcaaggaactcaaatgtggaagtggaattttcgtcactaatgaagtccacacctggacagagcaatacaaatttcaagcagactcccccaaaagactggcgacagccattgcaggtgcctgggagaatggagtgtgcggaatcaggtcgacaactagaatggagaacctcttgtggaagcaaatagccaatgaactgaactacatattatgggaaaacaacatcaaattaacggtagttgtgggtgacataattggggtcttagagcaagggaaaagaacactaacaccacaacccacggagctaaaatattcatggaaaacatggggaaaggcgaaaatagtgacagctgaaacacaaaattcttccttcataatagatgggccaaacacaccagagtgtccaagtgcctcaagagcatggaatgtgtgggaggtggaagaatacgggttcggagtcttcacaactaatatatggctgaaactccgagagatgtacacccaactatgtgaccacaggctaatgtcggcagccgttaaggatgagagagccgtacacgccgacatgggctattggatagaaagccaaaagaatggaagttggaagctagaaaaggcatccctcatagaggtgaaaacctgcacatggccaaaatcacacactctctggagcaacggtgtcctagagagtgacatgatcatcccgaagagtctggctggtcccatttcgcaacacaactacaggcccggataccacacccaaacggcaggaccctggcacctaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacacttcctcccctgcgatacatgggagaagacggctgctggtacggtatggaaattagacccattaatgagaaagaagagaacatggtaaagtctttagtctcagcagggagtggaaaggtggataacttcacaatgggtgtcttgtgtttggcaatcctctttgaagaggtgatgagaggaaaattcggaaaaaagcacatgattgcaggagttctcttcacatttgtgctccttctctcagggcaaataacatggagggacatggcgcgtacactcataatgattgggtccaacgcctctgacagaatgggaatgggcgtcacttacctagcattgattgcaacatttaaaattcagccatttttggccttgggattcttcctgaggaaactgacatctagagaaaatttattgttgggagttgggctggccatggcaacaacgttacaactgccagaggacattgaacaaatggcgaatggaatagctttggggcttatggctctcaaattgataacacaatttgaaacataccaactatggacggcattagtctccctaatgtgttcaaacacaattttcacgttgactgttgcctggagaacagccaccctgattttggccggaatttcgcttttgccagtgtgccagtcttcgagcatgaggaaaacagattggctcccaatgactgtggcagctatgggagttccacccctaccactttttatcttcagtttaaaagatacgctcaaaaggagaagctggccactgaatgagggggtaatggccgtcggacttgtgagcattctagcaagttctctccttaggaatgacgtacccatggctggaccattagtggctgggggcttgctgatagcgtgctacgtcataactggcacgtcagcagacctcactgtagaaaaagcagcaaatgtgacatgggaggaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatctttccatactccatacccgcaacactgttggtctggcacacttggcaaaagcaaacccaaagatccggcgttctatgggacgtccccagccccccagagacacagaaagcagaactggaagatggggtctataggatcaagcagcaaggaatttttgggaagacccaagtgggggttggagtacaaaaagaaggagttttccacaccatgtggcacgtcacaagaggagcagtgttgacacacaatgggaaaagactggaaccaaactgggctagcgtgaaaaaagatctgatctcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactgtatggcaatggagtggtcacaaagaatggtggctatgtcagtggaatagctcaaacaaacgcagagccagatggaccgacaccagagctggaagaagagatgttcaaaaagcgaaatctaaccataatggatctccatcccgggtcaggaaagacgcggaaataccttccagctattgttagagaggcaatcaagagacgcttaaggactctaattttggcaccaacaagggtggttgcagctgagatggaagaagcattgaaagggctcccaataaggtatcaaacgactgcaacaaaatctgaacacacagggaaagagattgttgatctaatgtgtcacgcaacgttcacaatgcgtttgctgtcaccagtcagagttccaaactataacttgataataatggatgaggctcatttcacagatccagccagtatagcggctagagggtacatatcaactcgtgtaggaatgggagaggcagccgcaattttcatgacagccacaccccctggtacagctgatgcctttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcggaaaaatggaaaaaaggtcattcaacttagtaggaagacttttgacacagaatatcaaaagactaaattaaatgattgggactttgtggtgacaacagacatttcagaaatgggagccaatttcaaagcagacagagtgatcgacccaagaagatgtctcaagccagtcattttgacagacggacctgagcgcgtgatcctggcgggaccaatgccagtcaccgtagcgagtgctgcgcaaaggagagggagagttggcaggaacccacaaaaagaaaatgaccaatacatattcacgggccagcccctcaacaatgatgaagaccacgctcactggacagaagcaaaaatgctgctagacaacatcaacacaccagaagggatcataccagctctctttgaaccagaaagggagaagtctgccgccatagacggcgaataccgcctgaaaggtgaatctaggaagaccttcgtggaactcatgaggaggggtgacctcccagtctggctagcccataaagtagcgtcagaaggaatcaaatatacagacagaaaatggtgttttgatggagaacgcaacaatcaaattttagaggagaacatggatgtggaaatctggacaaaggaaggagaaaagaaaaaattgaggcctaggtggcttgatgcccgcacttattcagatcccttagcgctcaaggaattcaaggactttgcggctggtagaaagtcgatcgcccttgatcttgtgacagaaataggaagagtgccttcacatttagcccacagaacgagaaacgctctggacaatctggtgatgttgcacacgtcagaacacggtgggagggcctacaggcatgcagtggaggaattaccagaaacaatggaaacactcttactcctgggactcatgatcctattaacaggtggggcaatgcttttcttgatatcaggtaaagggattggaaagacttcaataggactcatttgtgtggttgcttccagcggtatgttatggatggctgatgtcccactccaatggatcgcgtcggccatagtcctggagttttttatgatggtgctacttataccagaaccagaaaagcagagaactccccaagacaatcaactcgcatatgtcgtgataggcatacttacattggctgcaatagtagcagccaatgaaatgggattgttggaaaccacaaagagagatttaggaatgtccaaagaaccaggtgttgtctctccaatcagctatttggatgtggatttgcacccagcatcagcctggacattgtatgctgtggccacaacagtaataacaccaatgttgagacataccatagagaattccacagcaaatgtgtccctggcggctatagccaaccaggcagtggtcctgatgggtttagacaaaggatggccgatatcgaaaatggacttaggcgtaccactattagcactgggctgctattcacaagtgaacccactaactctcacagcggcagtactcctgctagtcacgcactacgctattataggtccaggattgcaggcaaaagccactcgtgaagctcaaaaaaggacagctgctggaataatgaagaatccaacggtggatgggataatgacaatagacctagatcctgtaatatacgattcaaaatttgaaaagcaactaggacaggttatgctcctgattttgtgtgcagttcaactcttgttaatgagaacatcatgggcattttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagcgaggaacagggtcacaaggtgaaaccttgggagaaaagtggaaaaagaaattgaatcaattatcccggaaagagtttgacctttacaagaaatccggaatcactgaagtggatagaacagaagccaaagaggggttgaaaagaggagaaataacacaccatgccgtgtccagaggcagcgcaaaacttcaatggttcgtggagaggaacatggtcatccctgaaggaagagtcatagacttgggctgtggaagaggaggctggtcatattattgtgcaggactgaaaaaagttacagaagtgcgaggatacacaaaaggcggcccaggacatgaagaaccagtacctatgtctacatacggatggaacatagtcaagctaatgagtggaaaggatgtgttttatcttccacctgaaaagtgtgacactctattgtgtgacattggagaatcttcaccaagcccaacagtggaagaaagcagaaccataagagtcttgaagatggttgaaccatggctaaaaaataaccagttttgcattaaagtactgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacacataggagacccaccatagagaaagacgtggatttaggagcggggacccgacatgtaaatgcggaaccagaaacacccaacatggatgtcattggggaaagaataagaaggatcaaggaggagcatagttcaacgtggcactatgatgatgaaaatccttataaaacgtgggcttaccatggatcctatgaagttaaggccacaggctcagcctcctctatgataaatggagtcgtgaaactcctcacgaaaccatgggatgtggtgcccacggtgacacagatggcaatgacggacacaacccctttcggccagcaaagggtttttaaagagaaagtggacaccaggacacccagacccatgccaggaacaagaaaggttatggagatcacagcggaatggctttggagaaccctgggaaggaataaaagacccagattatgcacgagagaggagttcacaaaaaaggtcagaaccaacgcagctatgggcgccgtattcacagaggagaaccaatgggacagtgctagagctgctgttgaagatgaagaattctggaaactcgtggacagagaacgtgaactccacaaactgggcaagtgtggaagctgcgtttacaacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttatagtggagtagaaggggaaggactgcataagctgggatatatcttgagagatatttccaagatacccggaggagctatgtatgctgatgacacagctggttgggatacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaaggggcagtggacaggtgggaacttatggtctgaacacattcaccaacatggaagcccagttaatcagacaaatggaaggagaaggtgtgttgtcgaaggcagacctcgagaacccccatctgctagagaagaaaattacacaatggttggaagctgaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcgaagggatggcatgattggcaacaggtccctttctgctcccaccactttcatgaattgatcatgaaagatggaagaaagttggtagtcccctgcagaccccaggatgaattaatagggagagcgagaatctctcaaggggcaggatggagccttaaagaaactgcatgcctagggaaagcctacgcccaaatgtgggctctcatgtattttcacagaagagatcttagactggcatccaacgccatatgttcagcagtaccagtccattgggtccccacaagcaggacgacgtggtccattcatgctcaccatcagtggatgactacagaagacatgcttactgtttggaacagggtgtggatagaggataatccatggatggaagacaaaactccagtcacaacttgggaagatgtaccatatctagggaagagagaagaccaatggtgcggatcactcataggtcacacttccagagcaacctgggcccagaacatacttaccgcaatccaacaggtaagaagccttataggcaatgaagagtttctggactacatgccttcgatgaagagatttaggaaggaggaggagtcagagggagccatttggtaa

SEQ ID NO: 7182 - RNA, 9873 nt, synthetic construct
  misc_feature 1..9873: note = derived and/or modified CDS sequence (wt) from DENV-3__AB214879__SS-prME
  source 1..9873: mol_type = other RNA
acatcgctctgtctcatgatgatgttaccagcaacacttgctttccacttgacttcacgagatggagagccgcgcatgattgtggggaagaatgaaagaggaaaatccctgcttttcaagacagcctctggaatcaacatgtgcacactcatagccatggatttgggagaaatgtgtgatgacacggtcacttacaaatgccccctcattactgaagtggagcctgaggacattgactgctggtgcaacctcacatcgacgtgggtgacctacggaacgtgcaaccaagctggagagcatagacgcgataaaagatcggtggcgttagctccccatgttggcatgggactggacacacgcacccaaacctggatgtcggctgaaggagcttggagacaagtcgagaaggtagagacatgggcctttaggcacccagggttcacaatactagccctatttcttgcccattacatagggacttccttgacccagaaagtggtcattttcatactgttaatgttggtcactccatccatgacaatgagatgtgtgggagtaggaaacagagattttgtggaaggcctatcaggagctacgtgggttgacgtggtgctcgaacacggtgggtgtgtgactaccatggctaagaacaagcccacgctggatatagagctccagaagaccgaggccacccaactagcaaccctaaggaaactatgcattgagggaaaaatcaccaacgtgacaaccgactcaaggtgccccacccaaggggaagcgattttacctgaggagcaggaccagaactacgtgtgtaagcacacatacgtggacagaggctggggaaacggttgtggcttgtttggcaagggaagcttggtaacatgcgcgaaatttcaatgtttggaatcaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccgtcttacctgaatatggaacccttgggctagaatgctcaccacgaacaggtttggactttaatgaaatgattttgttgacaatgaagaacaaagcatggatggtacacagacaatggttttttgacctacctctaccatggacatcaggggctacaacagaaacaccaacctggaataagaaagagcttcttgtgacattcaaaaacgcacacgcaaaaaaacaagaagtagtggtccttggatcgcaagagggagcaatgcacacagcactgacaggagctacagagatccaaacctcaggaggcacaagtgtttttgcggggcacttaaaatgcagactcaagatggacaaattggaactcaaggggatgagctatgcaatgtgctcaaatgcctttgtgttgaagaaagaagtctctgaaacacagcatggaacaatactcataaaggtcgagtacaaaggggaagatgcaccttgcaagattcctttctccacggaggatggacaagggaaagcccacaatggcagactgatcacagccaacccagtggtgaccaagaaggaagagcctgtcaatattgaggcagaacctccttttggggaaagtaacataataattggaattggggacaaagccttgaaaatcaattggtacaagaagggaagctcgattgggaagatgttcgaggccactgccagaggtgcaaggcgcatggccatcttgggagacacagcctgggacttcggatcagtaggtggtgttttaaattcattggggaaaatggtgcaccaaatatttggaagcgcttacacggccctttttagtggagtctcctggataatgaaaattggaataggtgtccttttaacttggatagggttgaattcaaaaaacacttctatgtcattttcatgcattgtgattggaatcatcacactctatctgggagctgtggtgcaagctgacatggggtgtgtcataaactggaaaggcaaagaacttaaatgtggaagtggaattttcgttactaatgaggtccacacctggacagagcaatacaaatttcaagcagactccccaaaaagactggcgacagccattgcaggcgcctgggagaatggagtgtgtggaatcaggtcgacaaccagaatggagaacctcttgtggaagcaaatagccaatgaactaaactacatattatgggaaaacaacattaaattaacggtagttgtgggtgatataattggggtcttagagcaagggaaaagaacactaacaccacaacccatggagctaaaatattcatggaaaacatggggaaaggcgaaaatagtgacagctgaaacacaaaattcttccttcataatagatgggcccaacacaccagagtgtccaagtgcctcgagagcatggaatgtgtgggaggtggaagattacgggttcggagttttcacaaccaatatatggctgaaactccgagagatgtacacccaactatgtgaccacaggctaatgtcggcagccgttaaggatgagagagccgtacacgccgacatgggctattggatagaaagccaaaagaatggaagttggaagctagaaaaggcatctctcatagaggtgaaaacctgcacatggccaaagtcacacactctctggagcaatggtgtgttggagagtgatatgatcatcccaaagagtctagctggtcctatctcgcaacacaactacaggcccggataccacacccaaacggcaggaccctggcacctaggaaaactggagctggactttaactattgtgagggaacaacagttgtcatcacagaaaattgtgggacaagaggcccatcactgaggacaacaacagtgtcagggaaattgatacacgaatggtgttgccgctcgtgcacacttcctcctctgcgatacatgggagaagacggctgctggtatggcatggaaattagacccattaatgagaaagaagagaatatggtaaagtctttagtctcagcagggagtggaaaggtggacaacttcacaatgggtgtcttgtgtttggcaatcctctttgaagaggtaatgagaggaaaattcggaaaaaagcacatgattgcaggagttctcttcacatttgtgctccttctctctgggcaaataacatggagagacatggcgcgtacactcataatgattgggtccaacgcctctgacagaatgggaatgggcgtcacttacctagcattgattgcaacatttaaaattcagccatttttggctttgggattcttcctgaggaaactgacatctagagaaaatttattgttgggagttgggttggccatggcaacaacgttgcaactgccagaggacattgaacaaatggcgaatggaatagccttggggctcatggctcttaaattgataacacaattcgaaacataccaactgtggacggcattaacctccctaatgtgttcaaacacaattttcacgttgactgttgcctggagaacagccaccctgattttggccggaatttcgcttttgccagtgtgccagtcttcgagcatgaggaaaacagattggctgccaatgactgtggcagctatgggagttccacctctaccactttttatcttcagtttgaaagacacactcaaaaggagaagctggccactgaatgagggggtgatggccgttggacttgtgagcattttggcaagctctctccttaggaatgacgtacccatggctggaccattagtggctgggggcttgctgatagcgtgctacgtcataactggcacgtcagcagaccttactgtagaaaaagcagcagatgtgacatgggaggaagaggctgagcaaacaggagtgtcccacaatctaatgatcacagttgatgatgatggaacaatgagaataaaagatgatgagactgagaacatcttaacagtgcttttgaaaacagcattactaatagtgtcaggcatttttccatactccatacccgcaacactgttggtctggcatacttggcaaaagcaaacccaaagatccggcgtcctatgggacgtacctagccccccagagacacagaaagcagaactggaagaaggggtctataggatcaagcagcaaggaatttttgggaagacccaagtgggggttggagtacaaaaagaaggagttttccacaccatgtggcacgtcacaagaggagcagtgttgacacacaatgggaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacgacaggggagataggagcgattgcactggacttcaagcctggaacttcaggatctcccatcataaacagagagggaaaggtagtgggactgtatggcaatggagtggtcacaaagagtggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagccatagttagagaggcaatcaagagacgcttaaggaccctaattttggcaccaacaagggtggttgcagctgagatggaagaagcattgaaagggctcccaataaggtatcaaacaactgcaacaaaatccgaacacacagggaaagagattgttgatctaatgtgtcatgcaacgttcacaatgcgtttgctgtcaccagtcagagttccaaactacaacttgataataatggatgaggctcatttcacagacccagccagtatagcggctagagggtacatatcaactcgtgtgggaatgggagaggcagccgcaattttcatgacagccacaccccctggaacagctgatgcctttcctcagagcaacgctccaattcaagatgaagaaagagacatcccagaacgctcatggaattcaggcaatgattggattaccgactttgccgggaagactgtgtggtttgtccccagcatcaaagctggaaatgacatagcaaactgcttgcgaaaaaatggaaaaaaggtcattcaacttagtaggaaaacttttgacacagaatatcaaaagactaaactaaatgattgggactttgtggtgacaacagacatttcggaaatgggagccaatttcaaagcagacagagtgatcgacccaagaagatgtctcaagccagtcattttgacagacggacccgagcgtgtgatcctggcaggaccaatgccagtcaccgtagcgagtgctgcacaaaggagagggagagttggcaggaacccacaaaaagaaaatgaccaatacatattcacgggccagcccctcaacaatgatgaagaccacgctcactggacagaagcaaaaatgctgctagacaacattaacacaccagaagggatcataccagctctctttgaaccagaaagggagaagtcagccgccatagacggcgaataccgcctgaaaggtgagtcccggaagactttcgtggaactcatgaggaggggtgacctcccagtttggctagcccataaagtagcatcagaaggaatcaaatacacagatagaaaatggtgttttgatggagagcgcaacaatcaaattttagaggagaatatggatgtggaaatttggacaaaggaaggagaaaagaaaaaattgaggcctaggtggcttgacgcccgcacttattcagatcccttagcgctcaaggaattcaaggactttgcggctggtagaaagtcgatcgcctttgatcttgtaacagaaataggaagagtgccttcacatttagcccacagaacgagaaatgctctggacaatttggtaatgttgcacacgtcagaacacggtgggagggcctacaggcatgcagtggaggaattaccagaaacaatggaaacactcttactcctgggactcatgatcctgttaacaggtggggcaatgcttttcttgatatcaggcaaagggattggaaagacttcaataggactcatttgtgtagttgcttccagcggcatgttatggatggctgatatcccactccaatggatcgcgtcggccatagttctggagttttttatgatggtgctacttataccagaaccagaaaagcagagaactccccaagataatcaactcgcatatgtcgtgataggcatacttacattggctgcaatagtagcagccaatgaaatgggattgttggaaaccacaaagagagatttggggatgtccaaagaaccaggtgttgtttctccaaccagctatttggatgtggatttgcacccagcatcagcttggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggatttaggcgtaccactattggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaacccaacggtggatgggataatgacaatagacctagatcctgtaatatacgattcaaaatttgaaaaacaactaggacaagttatgctcctggttctgtgtgcagttcaactcttgttaatgagaacatcatgggcattttgtgaagctctaaccctagccacaggaccaataacaacactctgggaaggatcaccagggaagttctggaacaccacgatagctgtttccatggcgaacatctttagagggagctatttagcaggagctgggctcgctttttctatcatgaaatcagttggaacaggaaagagaggaacagggtcacaaggtgaaactttgggagaaaagtggaaaaagaaattgaatcaattgtcccggaaagagtttgacctttacaagaaatccggaatcactgaagtggatagaacagaagctaaagaagggttgaaaagaggagaaataacacaccatgccgtatccagaggcagcgcaaaacttcaatggttcgtggagagaaacatggtcatccctgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctaatgagtggaaaggatgtgttttatcttccacctgaaaagtgtgacactctattgtgtgacattggagagtcttcaccaagcccaacagtggaagagagcagaaccataagagtcttgaaaatggttgaaccatggctaaaaaacaaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactactactgaacagattcacaatgacatataggagacccaccatagagaaagatgtggatttaggagcggggacccgacatgtcaatgcggaaccagaaacacctaacatggatgtcattggggaaagaataaggaggattaaggaggagcatagttcaacatggcactatgatgatgaaaatccttacaaaacgtgggcttaccatggatcttatgaagttaaggccacaggttcagcctcctccatgataaatggagtcgtaaaactcctcacgaaaccatgggatgtggtgcccacggtgacacagatggcaatgacggacacaaccccctttggccagcaaagggtttttaaagagaaagtggacaccaggacacccaaacccatgccaggaacaagaaaggtcatggagatcacagcagaatggctctggagaaccctgggaaggaataaaagacccagattatgcacgagagaggagttcacaaaaaaggtcagaaccaacgcagctatgggcgccgtattcacagaggagaaccaatgggacagtgccagagctgccgttgaagatgaagaattctggaaactcgtggacagagaacgtgagctccacaaactgggcaagtgtggaagctgcgtttataacatgatgggcaagagagagaagaaacttggagagtttggcaaagcaaaaggcagtagagccatatggtacatgtggctgggagccaggtaccttgagttcgaggcactcggattcttaaatgaagaccattggttctcgcgcgaaaactcttacagtggagtagaaggggaaggactgcataagctgggatacatcttgagagacatttccaagataccaggaggagccatgtatgctgatgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgattagacaaatggaaggagaaggtgtgttgtcgaagacagacctcgagaaccctcatctgctagagaagagaattacacaatggttggaaaccaaaggagtggagaggttaaaaagaatggccatcagcggggacgattgcgtggtgaaaccaatcgatgacaggttcgccaatgccctgcttgccctgaatgacatgggaaaagttaggaaggacatacctcaatggcaaccatcgaagggatggcatgattggcaacaggtccctttctgctcccaccactttcatgaattgattatgaaagatggaagaaagttggtagtcccctgcagacctcaggatgaattaatagggagagcgagaatctctcaaggagcaggatggagccttaaagaaactgcatgcctagggaaagcctacgcccaaatgtgggctctcatgtattttcacagaagagatcttagactagcctccaacgccatatgttcagcagtaccagtccattgggtccccacaagcagaacgacttggtccatccatgctcaccatcagtggatgactacagaagatatgcttactgtttggaacagggtgtggatagaggacaatccatggatggaagataaaactccagttacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccttcgatgaagagattcaggaaggaggaggagtcagagggagccatttggtaa

SEQ ID NO: 7183 - RNA, 9873 nt, synthetic construct
  misc_feature 1..9873: note = derived and/or modified CDS sequence (wt) from DENV-3__AB214880__SS-prME
  source 1..9873: mol_type = other RNA
acatcgctctgtctcatgatgatgttaccagcaacacttgctttccacttgacttcacgagatggagagccgcgcatgattgtggggaagaatgaaagaggaaaatccctgcttttcaagacagcctctggaatcaacatgtgcacactcatagccatggatttgggagaaatgtgtgatgacacggtcacttacaaatgccccctcattactgaagtggagcctgaggacattgactgctggtgcaacctcacatcgacgtgggtgacctacggaacgtgcaaccaagctggagagcatagacgcgataaaagatcggtggcgttagctccccatgttggcatgggactggacacacgcacccaaacctggatgtcggctgaaggagcttggagacaagtcgagaaggtagagacatgggcctttaggcacccagggttcacaatactagccctatttcttgcccattacatagggacttccttgacccagaaagtggtcattttcatactgttaatgttggtcactccatccatgacaatgagatgtgtgggagtaggaaacagagattttgtggaaggcctatcaggagctacgtgggttgacgtggtgctcgaacacggtgggtgtgtgactaccatggctaagaacaagcccacgctggatatagagctccagaagaccgaggccacccaactagcaaccctaaggaaactatgcattgagggaaaaatcaccaacgtgacaaccgactcaaggtgccccacccaaggggaagcgattttacctgaggagcaggaccagaactacgtgtgtaagcacacatacgtggacagaggctggggaaacggttgtggcttgtttggcaagggaagcttggtaacatgcgcgaaatttcaatgtttggaatcaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccgtcttacctgaatatggaacccttgggctagaatgctcaccacggacaggtttggactttaatgaaatgattttgttgacaatgaagaacaaagcatggatggtacacagacaatggttttttgacctacctctaccatggacatcaggggctacaacagaaacaccaacctggaataagaaagagcttcttgtgacattcaaaaacgcacacgcaaaaaaacaagaagtagtggtccttggatcgcaagagggagcaatgcacacagcactgacaggagctacagagatccaaacctcaggaggcacaagtatttttgcggggcacttaaaatgcagactcaagatggacaaattggaactcaaggggatgagctatgcaatgtgctcaaatgcctttgtgttgaagaaagaagtctctgaaacacagcatggaacaatactcataaaggtcgagtacaaaggggaagatgcaccttgcaagattcctttctccacggaggatggacaagggaaagcccacaatggcagactgatcacagccaacccagtggtgaccaagaaggaggagcctgtcaatattgaggcagaacccccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcattggggaaaatggtgcaccaaatatttggaagcgcttacacggccctttttagtggagtctcctggataatgaaaattggaataggtgtccttttaacttggatagggttgaattcaaaaaacacttctatgtcattttcatgcattgtgattggaatcatcacactctatctgggagctgtggtgcaagctgacatggggtgtgtcataaactggaaaggcaaagaacttaaatgtggaagtggaattttcgttactaatgaggtccacacctggacagagcaatacaaatttcaagcagactccccaaaaagactggcgacagccattgcaggcgcctgggagaatggagtgtgtggaatcaggtcgacaaccagaatggagaacctcttgtggaagcaaatagccaatgaactaaactacatattatgggaaaacaacattaaattaacggtagttgtgggtgatataattggggtcttagagcaagggaaaagaacactaacaccacaacccatggagctaaaatattcatggaaaacatggggaaaggcgaaaatagtgacagctgaaacacaaaattcttccttcataatagatgggcccaacacaccagagtgtccaagtgcctcgagagcatggaatgtgtgggaggtggaagattacgggttcggagttttcacaaccaatatatggctgaaactccgagagatgtacacccaactatgtgaccacaggctaatgtcggcagccgttaaggatgagagagccgtacacgccgacatgggctattggatagaaagccaaaagaatggaagttggaagctagaaaaggcatctctcatagaggtgaaaacctgcacatggccaaagtcacacactctctggagcaatggtgtgttggagagtgatatgatcatcccaaagagtctagctggtcctatctcgcaacacaactacaggcccggataccacacccaaacggcaggaccctggcacctaggaaaattggagctggactttaactattgtgagggaacaacagttgtcatcacagaaaattgtgggacaagaggcccatcactgaggacaacaacagtgtcagggaaattgatacacgaatggtgttgccgctcgtgcacacttcctcctctgcgatacatgggagaagacggctgctggtatggcatggaaattagacccattaatgagaaagaagagaatatggtaaagtctttagtctcagcagggagtggaaaggtggacaacttcacaatgggtgtcttgtgtttggcaatcctctttgaagaggtaatgagaggaaaattcggaaaaaagcacatgattgcaggggttctcttcacatttgtgctccttctctctgggcaaataacatggagagacatggcgcgtacactcataatgattgggtccaacgcctctgacagaatgggaatgggcgtcacttacctagcattgattgcaacatttaaaattcagccatttttggctttgggattcttcctgaggaaactgacatctagagaaaatttattgttgggagttgggttggccatggcaacaacgttgcaactgccagaggacattgaacaaatggcgaatggaatagccttggggctcatggctcttaaattgataacacaattcgaaacataccaactgtggacggcattagcctccctaatgtgttcaaacacaattttcacgttgactgttgcctggagaacagccaccctgattttggccggaatttcgcttttgccagtgtgccagtcttcgagcatgaggaaaacagattggctgccaatgactgtggcagctatgggagttccacctctaccactttttatcttcagtttgaaagacacactcaaaaggagaagctggccactgaatgagggggtgatggccgttggacttgtgagcattttggcaagctctctccttaggaatgacgtacccatggctggaccattagtggctgggggcttgctgatagcgtgctacgtcataactggcacgtcagcagaccttactgtagaaaaagcagcagatgtgacatgggaggaagaggctgagcaaacaggagtgtcccacaatctaatgatcacagttgatgatgatggaacaatgagaataaaagatgatgagactgagaacatcttaacagtgcttttgaaaacagcattactaatagtgtcaggcatttttccatactccatacccgcaacactgttggtctggcatacttggcaaaagcaaacccaaagatccggcgtcctatgggacgtacctagccccccagagacacagaaagcagaactggaagaaggggtctataggatcaagcagcaaggaatttttgggaagacccaagtgggggttggagtacaaaaagaaggagttttccacaccatgtggcacgtcacaagaggagcagtgttgacacacaatgggaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacgacaggggagataggagcgattgcactggacttcaagcctggaacatcaggatctcccatcataaacagagagggaaaggtagtgggactgtatggcaatggagtggtcacaaagagtggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagccatagttagagaggcaatcaagagacgcttaaggaccctaattttggcaccaacaagggtggttgcagctgagatggaagaagcattgaaagggctcccaataaggtatcaaacaactgcaacaaaatccgaacacacagggaaagagattgttgatctaatgtgtcatgcaacgttcacaatgcgtttgctgtcaccagtcagagttccaaactacaacttgataataatggatgaggctcatttcacagacccagccagtatagcggctagagggtacatatcaactcgtgtgggaatgggagaggcagccgcaattttcatgacagccacaccccctggaacagctgatgcctttcctcagagcaacgctccaattcaagatgaagaaagagacatcccagaacgctcatggaattcaggcaatgattggattaccgactttgccgggaagactgtgtggtttgtccccagcatcaaagctggaaatgacatagcaaactgcttgcgaaaaaatggaaaaaaggtcattcaacttagtaggaaaacttttgacacagaatatcaaaagactaaactaaatgattgggactttgtggtgacaacagacatttcggaaatgggagccaatttcaaagcagacagagtgatcgacccaagaagatgtctcaagccagtcattttgacagacggacccgagcgtgtgatcctggcaggaccaatgccagtcaccgtagcgagtgctgcacaaaggagagggagagttggcaggaacccacaaaaagaaaatgaccaatacatattcacgggccagccccttaacaatgatgaagaccacgctcactggacagaagcaaaaatgctgctagacaacattaacacaccagaagggatcataccagctctctttgaaccagaaagggagaagtcagccgccatagacggcgaataccgcctgaaaggtgagtcccggaagactttcgtggaactcatgaggaggggtgacctcccagtttggctagcccataaagtagcatcagaaggaatcaaatacacagatagaaaatggtgttttgatggagagcgcaacaatcaaattttagaggagaatatggatgtggaaatttggacaaaggaaggagaaaagaaaaaattgaggcctaggtggcttgacgcccgcacttattcagatcccttagcgctcaaggaattcaaggactttgcggctggtagaaagtcgatcgcctttgatcttgtaacagaaataggaagagtgccttcacatttagcccacagaacgagaaatgctctggacaatttggtaatgttgcacacgtcagaacacggtgggagggcctacaggcatgcagtggaggaattaccagaaacaatggaaacactcttactcctgggactcatgatcctgttaacaggtggggcaatgcttttcttgatatcaggcaaagggattggaaagacttcaataggactcatttgtgtagttgcttccagcggcatgttatggatggctgatatcccactccaatggatcgcgtcggccatagttctggagttttttatgatggtgctacttataccagaaccagaaaagcagagaactccccaagataatcaactcgcatatgtcgtgataggcatacttacattggctgcaatagtagcagccaatgaaatgggattgttggaaaccacaaagagagatttggggatgtccaaagaaccaggtgttgtttctccaaccagctatttggatgtggatttgcacccagcatcagcttggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggatttaggcgtaccactactggcactgggttgctattcacaagtgaacccactaactctcacagcggcagtactcctgctagtcacgcattatgccattataggtccaggattgcaggcaaaagccactcgtgaagctcaaaaaaggacggctgctggaataatgaagaacccaacggtggatgggataatgacaatagacctagatcctgtaatatacgattcaaaatttgaaaaacaactaggacaagttatgctcctggttctgtgtgcagttcaactcttgttaatgagaacatcatgggcattttgtgaagctctaaccctagccacaggaccaataacaacactctgggaaggatcaccagggaagttctggaacactacgatagctgtttccatggcgaacatctttagagggagctatttagcaggagctgggctcgctttttctatcatgaaatcagttggaacaggaaagagaggaacagggtcacaaggtgaaactttgggagaaaagtggaaaaagaaattgaatcaattgtcccggaaagagtttgacctttacaagaaatccggaatcactgaagtggatagaacagaagctaaagaagggttgaaaagaggagaaataacacaccatgccgtatccagaggcagcgcaaaacttcaatggttcgtggagagaaacatggtcatccctgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctaatgagtggaaaggatgtgttttatcttccacctgaaaagtgtgacactctattgtgtgacattggagagtcttcaccaagcccaacagtggaagagagcagaaccataagagtcttgaaaatggttgaaccatggctaaaaaacaaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactactactgaacagattcacaatgacatataggagacccaccatagagaaagatgtggatttaggagcggggacccgacatgtcaatgcggaaccagaaacacctaacatggatgtcattggggaaagaataaggaggattaaggaggagcatagttcaacatggcactatgatgatgaaaatccttacaaaacgtgggcttaccatggatcttatgaagttaaggccacaggttcagcctcctccatgataaatggagtcgtaaaactcctcacgaaaccatgggatgtggtgcccacggtgacacagatggcaatgacggacacaaccccctttggccagcaaagggtttttaaagagaaagtggacaccaggacacccaaacccatgccaggaacaagaaaggtcatggagatcacagcagaatggctctggagaaccctgggaaggaataaaagacccagattatgcacgagagaggagttcacaaaaaaggtcagaaccaacgcagctatgggcgccgtattcacagaggagaaccaatgggacagtgccagagctgccgttgaagatgaagaattctggaaactcgtggacagagaacgtgagctccacaaactgggcaagtgtggaagctgcgtttataacatgatgggcaagagagagaagaaacttggagagtttggcaaagcaaaaggcagtagagccatatggtacatgtggctgggagccaggtaccttgagttcgaggcactcggattcttaaatgaagaccattggttctcgcgtgaaaactcttacagtggagtagaaggggaaggactgcataagctgggatacatcttgagagacatttccaagataccaggaggagccatgtatgctgatgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgattagacaaatggaaggagaaggtgtgttgtcgaagacagacctcgagaaccctcatctgctagagaagagaattacacaatggttggaaaccaaaggagtggagaggttaaaaagaatggccatcagcggggacgattgcgtggtgaaaccaatcgatgacaggttcgccaatgccctgcttgccctgaatgacatgggaaaagttaggaaggacatacctcaatggcaaccatcgaagggatggcatgattggcaacaggtccctttctgctcccaccactttcatgaattgattatgaaagatggaagaaagttggtagtcccctgcagacctcaggatgaattaatagggagagcgagaatctctcaaggagcaggatggagccttaaagaaactgcatgcctagggaaagcctacgcccaaatgtgggctctcatgtattttcacagaagagatcttagactagcctccaacgccatatgttcagcagtaccagtccattgggtccccacaagcagaacgacttggtccatccatgctcaccatcagtggatgactacagaagatatgcttactgtttggaacagggtgtggatagaggacaatccatggatggaagacaaaactccagttacaacttgggaagatgttccatatctagggaagagagaagaccaatggtgcggatcactcattggtctcacttccagagcaacctgggcccagaacatacttaccgcaatccaacaagtaagaagccttataggcaatgaagagtttctggactacatgccttcgatgaagagattcaggaaggaggaggagtcagagggagccatttggtaa

SEQ ID NO: 7184 - RNA, 9873 nt, synthetic construct
  misc_feature 1..9873: note = derived and/or modified CDS sequence (wt) from DENV-3__AB214881__SS-prME
  source 1..9873: mol_type = other RNA
acatcgctctgtctcatgatgatgttaccagcaacacttgctttccacttgacttcacgagatggagagccgcgcatgattgtggggaagaatgaaagaggaaaatccctgcttttcaagacagcctctggaatcaacatgtgcacactcatagccatggatttgggagaaatgtgtgatgacacggtcacttacaaatgccccctcatcactgaagtggagcctgaggacattgactgctggtgcaacctcacatcgacgtgggtgacctacggaacgtgcaaccaagctggagagcatagacgcgataaaagatcggtggcgttagctccccatgttggcatgggactggacacacgcacccaaacctggatgtcggctgaaggagcttggagacaagtcgagaaggtagagacatgggcctttaggcacccagggttcacaatactagccctatttcttgcccattacatagggacttccttgacccagaaagtggtcattttcatactgctaatgttggtcactccatccatgacaatgagatgtgtgggagtaggaaacagagattttgtggaaggcctatcaggagctacgtgggttgacgtggtgctcgaacacggtgggtgtgtgactaccatggctaagaacaagcccacgctggatatagagctccagaagaccgaggccacccaactagcaaccctaaggaaactatgcattgagggaaaaatcaccaacgtgacaactgactcaaggtgccccacccaaggggaagcgattttacctgaggagcaggaccagaactacgtgtgtaagcacacatacgtggacagaggctggggaaacggttgtggcttgtttggcaagggaagcttggtaacatgcgcgaaatttcaatgtttggaatcaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccgtcttacctgaatatggaacccttgggctagaatgctcaccacggacaggtttggactttaatgaaatgattttgttgacaatgaagaacaaagcatggatggtacacagacaatggttttttgacctacctctaccatggacatcaggggccacaacagaaacaccaacctggaataagaaagagcttcttgtgacattcaaaaacgcacacgcaaaaaaacaagaagtagtggtccttggatcgcaagagggagcaatgcacacagcactgacaggagctacagagatccaaacctcaggaggcacaagtatttttgcggggcacttaaaatgcagactcaagatggacaaattggaactcaaggggatgagctatgcaatgtgctcaaatgcctttgtgttgaagaaagaagtctctgaaacacagcatggaacaatactcataaaggtcgagtacaaaggggaagatgcaccctgcaagattcctttctccacggaggatggacaagggaaagcccacaatggcagactgatcacagccaacccagtggtgaccaagaaggaagagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcattggggaaaatggtgcaccaaatatttggaagcgcttacacggccctttttagtggagtctcctggataatgaaaattggaataggtgtccttttaacttggatagggttgaattcaaaaaacacttctatgtcattttcatgcattgtgattggaatcatcacactctatctgggagctgtggtgcaagctgacatggggtgtgtcataaactggaaaggcaaagaacttaaatgtggaagtggaattttcgttactaatgaggtccacacctggacagagcaatacaaatttcaagcagactccccaaaaagactggcgacagccattgcaggcgcctgggagaatggagtgtgtggaatcaggtcgacaaccagaatggagaacctcttgtggaagcaaatagccaatgaactaaactacatattatgggaaaacaacatcaaattaacggtagttgtgggtgatataattgggatcttagagcaagggaaaagaacactaacaccacaacccatggagctaaaatattcatggaaaacatggggaaaggcgaaaatagtgacagctgaaacacaaaattcttccttcataatagatgggcccaacacaccagagtgtccaagtgcctcgagagcatggaatgtgtgggaggtggaagattacgggttcggagttttcacaaccaatatatggctgaaactccgagagatgtacacccaactatgtgaccacaggctaatgtcggcagctgttaaggatgagagagccgtacacgccgacatgggctattggatagaaagccaaaagaatggaagttggaagctagaaaaggcatctctcatagaggtgaaaacctgcacatggccaaagtcacacactctctggagcaatggtgtgttggagagtgatatgatcatcccaaagagtctggctggtcctatctcgcaacacaactacaggcccggataccacacccaaacggcaggaccctggcacctaggaaaattggagctggactttaactattgtgagggaacaacagttgtcatcacagaaaattgtgggacaagaggcccatcactgaggaccacaacagtgtcagggaaattgatacacgaatggtgttgccgctcgtgcacacttcctcctctgcgatacatgggagaagacggctgctggtatggcatggaaattagacccattaatgagaaagaagagaatatggtaaagtctttagtctcagcagggagtggaaaggtggacaacttcacaatgggtgtcttgtgtttggcaatcctctttgaagaggtaatgagaggaaaattcggaaaaaagcacatgattgcaggggttctcttcacatttgtgctccttctctccgggcaaataacatggagagacatggcgcgtacactcataatgattgggtccaacgcctctgacagaatgggaatgggcgtcacttacctagcattgattgcaacatttaaaattcagccatttttggctttgggattcttcctgaggaaactgacatctagagaaaatttattgttgggagttgggttggccatggcaacaacgttgcaactgccagaggacattgaacaaatggcgaatggaatagccttggggctcatggctcttaaattgataacacaattcgaaacataccaattgtggacggcattagcctccctaatgtgttcaaacacaattttcacgttgactgttgcctggagaacagccaccctgattttggccggaatttcgcttttgccagtgtgccagtcttcgagcatgaggaaaacagattggctaccaatgactgtggcagctatgggagttccacctctaccactttttatcttcagtttgaaagacacactcaaaaggagaagctggccactgaatgagggggtgatggccgttggacttgtgagcattttggcaagctctctccttaggaatgacgtacccatggctggaccattagtggctgggggcttgctgatagcgtgctacgtcataactggcacgtcagcagaccttactgtagaaaaagcagcagatgtgacatgggaggaagaggctgagcaaacaggagtgtcccacaatctaatgatcacagttgatgatgatggaacaatgagaataaaagatgatgagactgagaacatcttaacagtgcttttgaaaacagcattactaatagtgtcaggcatttttccatactccatacccgcaacactgttggtctggcatacttggcaaaagcaaacccaaagatccggcgtcctatgggacgtacctagccccccagagacacagaaagcagaactggaagaaggggtctataggatcaagcagcaaggaatttttgggaagacccaagtgggggttggagtacaaaaagaaggagttttccacaccatgtggcacgtcacaagaggagcagtgttgacacacaatgggaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacgacaggggagataggagcgattgcactggacttcaagcctggaacttcaggatctcccatcataaacagagagggaaaggtagtgggactgtatggcaatggagtggtcacaaagagtggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagccatagttagagaggcaatcaagagacgcttaaggaccctaattttggcaccaacaagggtggttgcagctgagatggaagaagcattgaaagggctcccaataaggtatcaaacaactgcaacaaaatccgaacacacagggaaagagattgttgatctaatgtgtcatgcaacgttcacaatgcgtttgctgtcaccagtcagagttccaaactacaacttgataataatggatgaggctcatttcacagacccagccagtatagcggctagagggtacatatcaactcgtgtgggaatgggagaggcagccgcaattttcatgacagccacaccccctggaacagctgatgcctttcctcagagcaacgctccaattcaagatgaagaaagagacatcccagaacgctcatggaattcaggcaatgattggattaccgactttgccgggaagactgtgtggtttgtccccagcatcaaagctggaaatgacatagcaaactgcttgcgaaaaaatggaaaaaaggtcattcaacttagtaggaaaacttttgacacagaatatcaaaagactaaactaaatgattgggactttgtggtgacaacagacatttcggaaatgggagccaatttcaaagcagacagagtgatcgacccaagaagatgtctcaagccagtcattttgacagacggacccgagcgtgtgatcctggcaggaccaatgccagtcaccgtagcgagtgctgcacaaaggagagggagagttggcaggaacccacaaaaagaaaatgaccaatacatattcacgggccagcccctcaacaatgatgaagaccacgctcactggacagaagcaaaaatgctgctagacaacattaacacaccagaagggatcataccagctctctttgaaccagaaagggagaagtcagccgccatagacggcgaataccgcctgaaaggtgagtcccggaagactttcgtggaactcatgaggaggggtgacctcccagtttggctagcccataaagtagcatcagaaggaatcaaatacacagatagaaaatggtgttttgatggagagcgcaacaatcaaattttagaggagaatatggatgtggaaatttggacaaaggaaggagaaaagaaaaaattgaggcctaggtggcttgacgcccgcacttattcagatcccttagcgctcaaggaattcaaggactttgcggctggtagaaagtcgatcgcctttgatcttgtaacagaaataggaagagtgccttcacatttagcccacagaacgagaaatgctctggacaatttggtaatgttgcacacgtcagaacacggtgggagggcctacaggcatgcagtggaggaattaccagaaacaatggaaacactcttactcctgggactcatgatcctgttaacaggtggggcaatgcttttcttgatatcaggcaaagggattggaaagacttcaataggacttatttgtgtagttgcttccagcggcatgttatggatggctgatatcccactccaatggatcgcgtcggccatagttctggagttttttatgatggtgctacttataccagaaccagaaaagcagagaactccccaagataatcaactcgcatatgtcgtgataggcatacttacattggctgcaatagtagcggccaatgaaatgggattgttggaaaccacaaagagagatttggggatgtccaaagaaccaggtgttgtctctccaaccagctatttggatgtggatttgcacccagcatcagcttggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggatttaggcgtaccactattggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaacccaacggtggatgggataatgacaatagacctagatcctgtaatatacgattcaaaatttgaaaaacaactaggacaagttatgctcctggttctgtgtgcagttcaactcttgttaatgagaacatcatgggcattttgtgaagctctaaccctagccacaggaccaataacaacactctgggaaggatcaccagggaagttctggaacaccacgatagctgtttccatggcgaacatctttagagggagctatttagcaggagctgggctcgctttttctatcatgaaatcagttggaacaggaaagagaggaacagggtcacaaggtgaaactttgggagaaaagtggaaaaagaaattgaatcaattgtcccggaaagagttcgacctttacaagaaatccggaatcactgaagtggatagaacagaagctaaagaagggttgaaaagaggagaaataacacaccatgccgtatccagaggcagcgcaaaacttcaatggttcgtggagagaaacatggtcatccctgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctaatgagtggaaaggatgtgttttatcttccacctgaaaagtgtgacactctattgtgtgacattggagagtcttcaccaagcccaacagtggaagagagcagaaccataagagtcttgaaaatggttgaaccatggctaaaaaacaaccagttttgcatcaaagtattgaacccttatatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactactactgaacagattcacaatgacatataggagacccaccatagagaaagatgtggatttaggagcggggacccgacatgtcaatgcggaaccagaaacacctaacatggatgtcattggggaaagaataaggaggattaaggaggagcatagttcaacatggcactatgatgatgaaaatccttacaaaacgtgggcttaccatggatcttatgaagttaaggccacaggttcagcctcctccatgataaatggagtcgtaaaactcctcacgaaaccatgggatgtggtgcccacggtgacacagatggcaatgacggacacaaccccctttggccagcaaagggtttttaaagagaaagtggacaccaggacacccaaacccatgccaggaacaagaaaggtcatggagatcacagcagaatggctttggagaaccctgggaaggaataaaagacccagattatgcacgagagaggagttcacaaaaaaggtcagaaccaacgcagctatgggcgccgtattcacagaggagaaccaatgggacagtgccagagctgccgttgaagatgaagaattctggaaactcgtggacagagaacgtgagctccacaaactgggcaagtgtggaagctgcgtttataacatgatgggcaagagagagaagaaacttggagagtttggcaaagcaaaaggcagtagagccatatggtacatgtggctgggagccaggtaccttgagttcgaggcactcggattcttaaatgaagaccattggttctcgcgtgaaaactcttacagtggagtagaaggggaaggactgcataagctgggatacatcttgagagacatttccaagataccaggaggagccatgtatgctgatgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgattagacaaatggaaggagaaggtgtgttgtcgaagacagacctcgagaaccctcatctgctagagaagagaattacacaatggttggaaaccaaaggagtggagaggttaaaaagaatggccatcagcggggacgattgcgtggtgaaaccaatcgatgacaggttcgccaatgccctgcttgccctgaatgatatgggaaaagttaggaaggacatacctcaatggcaaccatcgaagggatggcatgattggcaacaggtccctttctgctcccaccactttcatgaattgattatgaaagatggaagaaagttggtagtcccctgcagacctcaggatgaattaatagggagagcgagaatctctcaaggagcaggatggagccttaaagaaactgcatgcctagggaaagcctacgcccaaatgtgggctctcatgtattttcacagaagagatcttagactagcctccaacgccatatgttcagcagtaccagtccattgggtccccacaagcagaacgacttggtccatccatgctcaccatcagtggatgactacagaagatatgcttactgtttggaacagggtgtggatagaggacaatccatggatggaagacaaaactccagttacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccttcgatgaagagattcaggaaggaggaggagttagagggagccatttggtaa

SEQ ID NO: 7185 - RNA, 9873 nt, synthetic construct
  misc_feature 1..9873: note = derived and/or modified CDS sequence (wt) from DENV-3__AB214882__SS-prME
  source 1..9873: mol_type = other RNA
acatcgctctgtctcatgatgatgttaccagcaacacttgctttccacttgacttcacgagatggagagccgcgcatgattgtggggaagaatgaaagaggaaaatccctgcttttcaagacagcctctggaatcaacatgtgcacactcatagccatggatttgggagaaatgtgtgatgacacggtcacttacaaatgccccctcattactgaagtggagcctgaggacattgactgctggtgcaacctcacatcgacgtgggtgacctacggaacgtgcaaccaagctggagagcatagacgcgataaaagatcggtggcgttagctccccatgttggcatgggactggacacacgcacccaaacctggatgtcggctgaaggagcttggagacaagtcgagaaggtagagacatgggcctttaggcacccagggttcacaatactagccctatttcttgcccattacatagggacttccttgacccagaaagtggtcattttcatactgctaatgttggtcactccatccatgacaatgagatgtgtgggagtaggaaacagagattttgtggaaggcctatcaggagctacgtgggttgacgtggtgctcgaacacggtgggtgtgtgactaccatggctaagaacaagcccacgctggatatagagctccagaagaccgaggccacccaactagcaaccctaaggaaactatgcattgagggaaaaatcaccaacgtgacaaccgactcaaggtgccccacccaaggggaagcgattttacctgaggagcaggaccagaactacgtgtgtaagcacacatacgtggacagaggctggggaaacggttgtggcttgtttggcaagggaagcttggtaacatgcgcgaaatttcaatgtttggaatcaatagagggaaaagtggtgcagcatgagaacctcaaatacaccgtcatcatcacggtgcacacaggagaccaacaccaggtgggaaatgaaacgcagggagtcacggctgagataacaccccaggcatcaaccgtcgaagccgtcttacctgaatatggaacccttgggctagaatgctcaccacggacaggtttggactttaatgaaatgattttgttgacaatgaagaacaaagcatggatggtacacagacaatggttttttgacctacctctaccatggacatcaggggctacaacagaaacaccaacctggaataagaaagagcttcttgtgacattcaaaaacgcacacgcaaaaaaacaagaagtagtggtccttggatcgcaagagggagcaatgcacacagcactgacaggagctacagagatccaaacctcaggaggcacaagtatttttgcggggcacttaaaatgcagactcaagatggacaaattggaactcaaggggatgagctatgcaatgtgctcaaatgcctttgtgttgaagaaagaagtctctgaaacacagcatggaacaatactcataaaggtcgagtacaaaggggaagatgcaccctgcaagattcctttctccacggaggatggacaagggaaagcccacaatggcagactgatcacagccaacccagtggtgaccaagaaggaagagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcattggggaaaatggtgcaccaaatatttggaagcgcttacacggccctttttagtggagtctcctggataatgaaaattggaataggtgtccttttaacttggatagggttgaattcaaaaaacacttctatgtcattttcatgcattgtgattggaatcatcacactctatctgggagctgtggtgcaagctgacatggggtgtgtcataaactggaaaggcaaagaacttaaatgtggaagtggaattttcgttactaatgaggtccacacctggacagagcaatacaaatttcaagcagactccccaaaaagactggcgacagccattgcaggcgcctgggagaatggagtgtgtggaatcaggtcgacaaccagaatggagaacctcttgtggaagcaaatagccaatgaactaaactacatattatgggaaaacaacatcaaattaacggtagttgtgggtgatataactgggatcttagagcaagggaaaagaacactaacaccacaacccatggagctaaaatattcatggaaaacatggggaaaggcgaaaatagtgacagctgaaacacaaaattcttccttcataatagatgggcccaacacaccagagtgtccaagtgcctcgagagcatggaatgtgtgggaggtggaagattacgggttcggagttttcacaaccaatatatggctgaaactccgagagatgtacacccaactgtgtgaccacaggctaatgtcggcagccgttaaggatgagagagccgtacacgccgacatgggctattggatagaaagccaaaagaatggaagttggaagctagaaaaggcatctctcatagaggtgaaaacctgcacatggccaaagtcacacactctctggagcaatggtgtgttggagagtgatatgatcatcccaaagagtctggctggtcctatctcgcaacacaactacaggcccggataccacacccaaacggcaggaccctggcacctaggaaaattggagctggactttaactattgtgagggaacaacagttgtcatcacagaaaattgtgggacaagaggcccatcactgaggacaacaacagtgtcagggaaattgatacacgaatggtgttgccgctcgtgcacacttcctcctctgcgatacatgggagaagacggctgctggtatggcatggaaattagacccattaatgagaaagaagagaatatggtaaagtctttagtctcagcagggagtggaaaggtggacaacttcacaatgggtgtcttatgtttggcaatcctctttgaagaggtaatgagaggaaaattcggaaaaaagcacatgattgcaggggttctcttcacatttgtgctccttctctctgggcaaataacatggagagacatggcgcgtacactcataatgattgggtccaacgcctctgacagaatgggaatgggcgtcacttacctagcattgattgcaacatttaaaattcagccatttttggctttgggattcttcctgaggaaactgacatctagagaaaatttattgttgggagttgggttggccatggcaacaacgttgcaactgccagaggacattgaacaaatggcgaatggaatagccttggggctcatggctcttaaattgataacacaattcgaaacataccaactgtggacggcattagcctccctaatgtgttcaaacacaattttcacgttgactgttgcctggagaacagccaccctgattttggccggaatttcgcttttgccagtgtgccagtcttcgagcatgaggaaaacagattggctaccaatgactgtggcagctatgggagttccacctctaccactttttatcttcagtttgaaagacacactcaaaaggagaagctggccactgaatgagggggtgatggccgttggacttgtgagcattttggcaagctctctccttaggaatgacgtacccatggctggaccattagtggctgggggcttgctgatagcgtgctacgtcataactggcacgtcagcagaccttactgtagaaaaagcagcagatgtgacatgggaggaagaggctgagcaaacaggagtgtcccacaatctaatgatcacagttgatgatgatggaacaatgagaataaaagatgatgagactgagaacatcttaacagtgcttttgaaaacagcattactaatagtgtcaggcatttttccatactccatacccgcaacactgttggtctggcatacttggcaaaagcaaacccaaagatccggcgtcctatgggacgtacctagccccccagagacacagaaagcagaactggaagaaggggtctataggatcaagcagcaaggaatttttgggaagacccaagtgggggttggagtacaaaaagaaggagttttccacaccatgtggcacgtcacaagaggagcagtgttgacacacaatgggaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacgacaggggagataggagcgattgcactggacttcaagcctggaacttcaggatctcccatcataaacagagagggaaaggtagtgggactgtacggcaatggagtggtcacaaagagtggtggctatgtcagtggaatagctcaaacaaacgcagaaccagacggaccgacaccagagttggaagaagagatgttcaaaaagcgaaatttaaccataatggatctccatcccgggtcaggaaagacgcggaaataccttccagccatagttagagaggcaatcaagagacgcttaaggaccctaattttggcaccaacaagggtggttgcagctgagatggaagaagcattgaaagggctcccaataaggtatcaaacaactgcaacaaaatccgaacacacagggaaagagattgttgatctaatgtgtcatgcaacgttcacaatgcgtttgctgtcaccagtcagagttccaaactacaacttgataataatggatgaggctcatttcacagacccagccagtatagcggctagagggtacatatcaactcgtgtgggaatgggagaggcagccgcaattttcatgacagccacaccccctggaacagctgatgcctttcctcagagcaacgctccaattcaagatgaagaaagagacatcccagaacgctcatggaattcaggcaatgattggattaccgactttgccgggaagactgtgtggtttgtccccagcatcaaagctggaaatgacatagcaaactgcttgcgaaaaaatggaaaaaaggtcattcaacttagtaggaaaacttttgacacagaatatcaaaagactaaactaaatgattgggactttgtggtgacaacagacatttcggaaatgggagccaatttcaaagcagacagagtgatcgacccaagaagatgtctcaagccagtcattttgacagacggacccgagcgtgtgatcctggcaggaccaatgccagtcaccgtggcgagtgctgcacaaaggagagggagagttggcaggaacccacaaaaagaaaatgaccaatacatattcacgggccagcccctcaacaatgatgaagaccacgctcactggacagaagcaaaaatgctgctagacaacattaacacaccagaagggatcataccagctctctttgaaccagaaagggagaagtcagccgccatagacggcgaataccgcctgaaaggtgagtcccggaagactttcgtggaactcatgaggaggggtgacctcccagtttggctagcccataaagtagcatcagaaggaatcaaatacacagatagaaaatggtgttttgatggagagcgcaacaatcaaattttagaggagaatatggatgtggaaatttggacaaaggaaggagaaaagaaaaaattgaggcctaggtggcttgacgcccgcacttattcagatcccttagcgctcaaggaattcaaggactttgcggctggtagaaagtcgatcgcctttgatcttgtaacagaaataggaagagtgccttcacatttagcccacagaacgagaaatgctctggacaatttggtaatgttgcacacgtcagaacacggtgggagggcctacaggcatgcagtggaggaattaccagaaacaatggaaacactcttactcctgggactcatgatcctgttaacaggtggggcaatgcttttcttgatatcaggcaaagggattggaaagacttcaataggactcatttgtgtagttgcttccagcggcatgttatggatggctgatatcccactccaatggatcgcgtcggccatagttctggagttttttatgatggtgctacttataccagaaccagaaaagcagagaactccccaagataatcaactcgcatatgtcgtgataggcatacttacattggctgcaatagtagcagccaatgaaatgggattgttggaaaccacaaagagagatttggggatgtccaaagaaccaggtgttgtttctccaaccagctatttggatgtggatttgcacccagcatcagcttggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggatttaggcgtaccactactggcactgggttgctattcacaagtgaacccactaactctcacagcggcagtactcctgctagtcacgcattatgccattataggtccaggattgcaggcaaaagccactcgtgaagctcaaaaaaggacggctgctggaataatgaagaacccaacggtggatgggataatgacaatagacctagatcctgtaatatacgattcaaaatttgaaaaacaactaggacaagttatgctcctggttctgtgtgcagttcaactcttgttaatgagaacatcatgggcattttgtgaagctctaaccctagccacaggaccaataacaacactctgggaaggatcaccagggaagttctggaacactacgatagctgtttccatggcgaacatctttagagggagctatttagcaggagctgggctcgctttttctatcatgaaatcagttggaacaggaaagagaggaacagggtcacaaggtgaaactttgggagaaaagtggaaaaagaaattgaatcaattgtcccggaaagagtttgacctttacaagaaatccggaatcactgaagtggatagaacagaagctaaagaagggttgaaaagaggagaaataacacaccatgccgtatccagaggcagcgcaaaacttcaatggttcgtggagagaaacatggtcatccctgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctaatgagtggaaaggatgtgttttatcttccacctgaaaagtgtgacactctattgtgtgacattggagagtcttcaccaagcccaacagtggaagagagcagaaccataagagtcttgaaaatggttgaaccatggctaaaaaacaaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactactactgaacagattcacaatgacatataggagacccaccatagagaaagatgtggatttaggagcggggacccgacatgtcaatgcggaaccagaaacacctaacatggatgtcattggggaaagaataaggaggattaaggaggagcatagttcaacatggcactatgatgatgaaaatccttacaaaacgtgggcttaccatggatcttatgaagttaaggccacaggttcagcctcctccatgataaatggagtcgtaaaactcctcacgaaaccatgggatgtggtgcccacggtgacacagatggcaatgacggacacaaccccctttggccagcaaagggtttttaaagagaaagtggacaccaggacacccaaacccatgccaggaacaagaaaggtcatggagatcacagcagaatggctctggagaaccctgggaaggaataaaagacccagattatgcacgagagaggagttcacaaaaaaggtcagaaccaacgcagctatgggcgccgtattcacagaggagaaccaatgggacagtgccagagctgccgttgaagatgaagaattctggaaactcgtggacagagaacgtgagctccacaaactgggcaagtgtggaagctgcgtttataacatgatgggcaagagagagaagaaacttggagagtttggcaaagcaaaaggcagtagagccatatggtacatgtggctgggagccaggtaccttgagttcgaggcactcggattcttaaatgaagaccattggttctcgcgtgaaaactcttacagtggagtagaaggggaaggactgcataagctgggatacatcttgagagacatttccaagataccaggaggagccatgtatgctgatgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgattagacaaatggaaggagaaggtgtgttgtcgaagacagacctcgagaaccctcatctgctagagaagagaattacacaatggttggaaaccaaaggagtggagaggttaaaaagaatggccatcagcggggacgattgcgtggtgaaaccaatcgatgacaggttcgccaatgccctgcttgccctgaatgacatgggaaaagttaggaaggacatacctcaatggcaaccatcgaagggatggcatgattggcaacaggtccctttctgctcccaccactttcatgaattgattatgaaagatggaagaaagttggtagtcccctgcagacctcaggatgaattaatagggagagcgagaatctctcaaggagcaggatggagccttaaagaaactgcatgcctagggaaagcctacgcccaaatgtgggctctcatgtattttcacagaagagatcttagactagcctccaacgccatatgttcagcagtaccagtccattgggtccccacaagcagaacgacttggtccatccatgctcaccatcagtggatgactacagaagatatgcttactgtttggaacagggtgtggatagaggacaatccatggatggaagacaaaactccagttacaacttgggaagatgttccatatctagggaagagagaagaccaatggtgcggatcactcattggtctcacttccagagcaacctgggcccagaacatacttaccgcaatccaacaggtaaggagccttataggcaatgaagagtttctggactacatgccttcgatgaagagattcaggaaggaggaggagtcagagggagccatttggtaa

SEQ ID NO: 7186 - RNA, 9873 nt, synthetic construct
  misc_feature 1..9873: note = derived and/or modified CDS sequence (wt) from DENV-3__JX669489__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattgacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcatcacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgctcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatagcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccaacctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgctaagacataccatagagaattctacagcaaatgtgtctctggcggctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtttttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgccaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7187 - RNA, 9873 nt, synthetic construct
  misc_feature 1..9873: note = derived and/or modified CDS sequence (wt) from DENV-3__JX669498__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttagtaacatgtgcgaaatttcaatgcctggaatcaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccattttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcatttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaactggagacaacgctttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagcgatatgatcatcccaaagagtttagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaagtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactacaacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagtggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaaaagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaagaacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgaaaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaggatttttggaaacttgtggacagagaacgtgaactccacaaactgggtaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggggtggagaggttaaaaagaatggccattagcggggatgattgcgtagtgaaaccaatcgatgacaggttcggtaatgccctgctcgctctgaacgatatgggaaaggttcggaaggacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7188 - RNA, 9873 nt, synthetic construct
  misc_feature 1..9873: note = derived and/or modified CDS sequence (wt) from DENV-3__KF954946__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagaaatgtgtgatgacacggtcacttacaaatgcccccacattaccgaagtggaacctgaagacattgactgctggtgcaaccttacatcaacatgggtgacttatggaacgtgtaatcaagctggagagcatagacgcgacaagagatcagtggcgttagctccccatgtcggcatgggactggacacacgcacccaaacctggatgtcggctgaaggagcttggagacaagtcgagaaggtagagacatgggcccttaggcatccagggttcaccatactagccctatttcttgcccattacataggcacctccttgacccagaaggtggttatttttatactactaatgctggtcaccccatccatgacaatgagatgtgtgggagtgggaaacagagattttgtggaaggtctgtcaggagctacgtgggttgacgtggtgctagagcacggggggtgtgtgaccaccatggctaagaacaagcccacgctggatatagagcttcagaagaccgaggccacccaactggcgatcctaaggaagctatgcattgaggggaaaattaccaacataacaactgactcaagatgtcccacccaaggagaagcggttttgcctgaggagcaggaccagaactacgtgtgtaagcacacatacgtagatagaggctgggggaacggctgtggtttgttcggcaagggaagcttggtaacatgtgcgaaatttcaatgcctggaaccgatagagggaaaagtagtgcaatatgagaacctcaaatacaccgtcatcattacagtgcacacaggagaccaacaccaggtgggaaatgaaacgcagggaatcacggctgagataacgcctcaggcatcaactactgaagccatcttgcctgaatatggaacccttgggctagaatgctcaccacggacaggtttggacttcaatgaaatgatcttactaacaatgaagaacaaagcatggatggtacacagacaatggttttttgacctacctctaccatggacatcaggagccacaacagaaacaccaacttggaacaggaaggagctccttgtgacattcaaaaatgcacatgcgaaaaaacaagaagtagttgtccttggatcgcaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgatcacagccaacccagtggtgactaagaaggaggagcctgtcaacattgaggctgaacctccttttggggaaagtaatatagtaattggaattggagacaatgccttgaaaatcaattggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtgatgaaaattggaataggtgttctcttaacttggatagggttgaattcaaaaaacacatccatgtcattttcatgcattgcaataggaatcatcacactctatttgggagctgtggtacaagctgacatggggtgtgtcataaactggaaaggcaaagaacttaaatgcggaagtggaattttcgtcaccaacgaggtccatacctggacagagcagtacaaattccaagcggattccccaaaaagattggcgacagctattgtaggtgcttgggaaaatggagtgtgtggaattaggtcaacaaccagaatggagaatctcttgtggaagcaaatagccaatgaactgaactacatattatgggaaaacaacatcaaattaacggtagttgtgggcgacacaatcggggttttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaaatgtgtgaccataggctaatgtcggcagccgtcaaggatgagagggccgtgcatgccgacatgggctactggatagaaagccaaaagaatggaagttggaagctagaaaaagcatccctcatagaggtgaaaacctgcacatggccaaaatcacacactctttggagcaacggtgtgctagagagtgacatgatcattccaaagagtctagctggtcctatttcgcaacacaactacaggcccgggtaccacacccaaacggcaggaccctggcacttaggaaaattggagctggacttcaactattgtgaaggaacaacagttgtcatcacagaaaattgtgggacaagaggcccatcattgagaacgacaacagtgtcaggaaagttgatacatgaatggtgttgccgctcgtgcacacttcctcccctgcgatacatgggagaagacggctgttggtatggcatggaaatcagacccatcagtgagaaagaagagaacatggtaaagtctttagtctcagcgggaagtggaaaggtagacaacttcacaatgggtgtcttgtgtttggcaatcctctttgaagaggtgatgagaggaaaatttgggaagaaacacatgattgcaggggttttcttcacgtttgtgctccttctctcagggcaaataacatggagagacatggcgcacacactaataatgattgggtccaacgcctctgacaggatgggaatgggcgtcacctatctagctttaattgcaacatttaaaatccagccattcctggctttgggatttttcctaagaaaactgacatctagagaaaatttactgttaggagtcggactggctatggcaacaacgttacaattgccagaggacattgaacaaatggcaaatggaatcgccctggggctcatggctcttaaattgataacacaatttgaaacataccaattatggacagcattaatctccttaacgtgttcaaatacaattttcacgttgactgttgcttggagaacagccaccctgattttggccggagtttcacttttaccagtgtgccagtcttcgagcatgagaaaaacagactggcttccaatgacagtggcagctatgggagtcccacccctaccactctttatttttagcttgaaagacacactcaaaaggagaagctggccactgaatgagggggtgatggctgttggacttgtgagcatgctggccagttctctccttagaaatgacgtgcccatggctggaccattagtggccgggggcttgctgatagcgtgctacgtcataactggcacgtcagcagaccttacagtggaaaaagcagcagatgtaacatgggaggaagaggctgagcaaacaggagtgtcccacaacttaatgatcacagttgatgatgatggaacaatgagaataaaagatgatgagactgagaatattctaacagtgcttttgaagacagcattactaatagtatcaggtatctttccatactccataccagcgacattgttggtctggcatacttggcaaaagcaaacccaaagatccggtgttctatgggacgtacccagccccccagagacacagaaagcagaactggaagaaggggtctataggatcaaacagcaaggaattcttgggaaaacccaagtaggggttggagtacaaaaagacggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaatccaaagaacttccaaaccatgccaggcacattccagactacaacaggggaaataggagcaattgcattggatttcaagcctggaacttcggggtctcctatcataaacagagagggaaaggtagtgggactatatggcaatggagtggttacaaagaatggcggctacgtcagcggaatagcgcaaacaaatgcagaaccagatggaccgacgccagagttggaagaagagatgttcaaaaagcgaaatctaaccataatggatcttcatcctgggtcaggaaagacacggaaatatcttccagccattgttagagaggcaatcaagagacgtttaagaactctgattctggcaccgacaagggtggttgcagctgagatggaagaagcattgaaggggctcccaataaggtaccaaacaacagcaacaaaatctgaacatacgggaagagagattgttgatctaatgtgccacgcaacgttcacaatgcgcttgctgtcaccagttagggttccaaattacaacttgataataatggatgaggcccatttcacagacccagccagtatagcggccagagggtacatatcaactcgtgttggaatgggagaggcagccgcaatcttcatgacggcaacgccccctggaacagctgatgcctttcctcagagcaacgctccaattcaagatgaagaaagggacataccagaacgctcatggaattcaggcaatgaatggatcaccgacttcgccgggaaaacggtgtggtttgtccccagcatcaaagccggaaatgacatagcaaactgcttgcgaaagaacgggaaaaaggtcattcaacttagtaggaagacttttgatacagaatatcagaagactaaactaaatgactgggactttgtggtgacaactgacatttcagaaatgggggccaatttcaaagcagatagagtgatcgacccaagaagatgtctaaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgacgaagaccatgctcactggacagaagcaaaaatgctgctggacaacatcaacactccagaaggaatcataccagctctctttgaaccagaaagggagaagtcagccgccatagacggtgaatatcgcctgaagggtgaatccaggaagactttcgtggaactcatgaggaggggtgacctcccagtttggttagcccacaaagtagcatcagaagggatcaaatatacagataggaaatggtgctttgatggacagcgcaacaatcaaattttagaggaaaacatggacgtggaaatctggacaaaggaaggagaaaagaaaaaattaagacctaggtggcttgatgcccgcacttattcagatcccttagcactcaaggaattcaaggactttgcggcaggcagaaagtcaatcgcccttgatcttgtgacagaaataggaagagtgccttcacacctagcccacagaacgagaaacgctctggacaatctggtgatgctgcacacgtcagaacatggcggtagggcctacaggcatgcggtggaggaactaccagaaacaatggaaacactcctactcttgggactcatgatcttactgacaggtggagcaatgcttttcttgatatcaggtaaagggattggaaagacttcaataggactcatttgtgtgattgcttccagcggcatgctgtggatggccgaaattccactccaatggatcgcgtcggctatagtcctggagttttttatgatggtgttgcttataccagaaccagaaaagcagagaaccccccaagacaaccaactcgcatatgtcgtaataggcatacttacaatggctgcaataatagcggccaatgaaatgggactactggaaactacaaagagagatctaggaatgtctaaggaaccaggtgttgtttctccaactagctatttggatgtggatttgcacccagcatcagcctggacattgtacgctgtggccactacagtaataacaccaatgttaagacataccatagagaattctacagcaaatgtgtccctggcagctatagccaaccaggcagtggtcctgttgggtttggacaaaggatggccaatatcaaaaatggacttaggcgtaccactactggcattgggttgctattcacaagtgaacccactgactctaacagcggcagtacttttgctagttacacattatgctattataggtccaggactgcaggcaaaagccactcgtgaagctcaaaaaaggacagctgctggaataatgaagaatccaacggtggatgggataataacaatagacctagaccctgtaatatatgattcaaaatttgaaaagcaactgggacaggtcatgctcctggttttgtgtgcagttcaactgttgttaatgagaacatcatgggccttgtgtgaagctttaactttagctacaggaccaataacaacactctgggaaggatcacctgggaagttttggaataccacgatagctgtttctatggcgaacatttttagagggagctatttagcaggagctgggcttgccttttctattatgaaatcagttggaacaggaaaaagaggaacaggctctcaaggtgaaactttaggagaaaaatggaaaaagaaattgaatcaattatcccggaaagagtttgacctttacaagaagtctggaatcactgaagtggatagaacagaagccaaagaagggttgaaaagaggagaaacaacacatcatgccgtgtccaggggtagtgcaaaacttcaatggtttgtggaaaggaacatggtcattcccgagggaagagtcatagacctgggctgtggaagaggaggctggtcatattactgtgcaggactgaaaaaagtcacagaagtgcgaggatacacaaaaggcggtccaggacacgaagaaccagtgcctatgtcaacatatggatggaacatagttaaattaatgagtggaaaggatgtgttttatcttccgcctgaaaagtgtgacaccctgttgtgtgacattggagaatcttcaccaagcccaacagtggaagaaagcagaactataagagttttgaagatggttgaaccatggctaaaaaacaaccagttttgcattaaagtattgaacccttacatgccagccgtgattgagcacctagaaagactgcaaaggaaacacggaggaatgcttgtgagaaatccactttcacgaaactccacgcacgaaatgtactggatatctaatggtacaggtaacattgtctcttcagttaacatggtatccagattgttactgaacaggttcacgatgacacacaggagacctaccatagagaaagatgtggatttaggagcaggaactcgacatgtcaatgcggaaccagaaacacccaacatggatgtcattggggaaagaataaaaaggatcaaggaggagcataattcaacatggcactatgatgacgaaaacccctacaaaacgtgggcttaccacggatcttatgaagtcaaggccacaggctcagcctcctccatgataaacggagtcgtgaaacttctcactaaaccatgggatgtagtgcccatggtgacacagatggcaatgacagatacaactccatttggccagcagagagtctttaaagagaaggtggacaccaggacacccaggcctatgccagggacaagaaaggttatggagatcacagcggagtggctctggagaaccctgggaaggaacaaaagacccaggttatgcacaagggaagagttcacaaaaaaggtcagaaccaacgcagccatgggcgccgttttcacagaggagaaccaatgggacagtgcgaaagccgctgttgaggatgaagagttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcacacaacaaatggaccctgaacacaggctgttagcgaacgctatatttaagctcacataccaaaacaaagtggtcaaagttcaacgaccgactccaacgggcacggtaatggacattatatctaggaaagaccaaagaggcagtggacaggtgggaacttatggtctgaacacatttactaacatggaagcccagttagtcagacaaatggaaggagaaggtgtgctgtcaaagacagacctcgagaaccctcatctgccagaaaagaaaattacacaatggctggaaaccaaaggagtggagaggttaaaaagaatggccattagcggggatgattgcgtagtgaaaccaatcgatgacaggttcgctaacgcactgcttgccctgaacgatatgggaaaggttcggaaagacatacctcaatggcagccatcaaagggatggcatgactggcagcaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtttggggaaagcctacgcccaaatgtggagtctcatgtattttcacagaagagatctcagactagcgtccaatgccatatgttcagcaataccagtccactgggtccccacaagtagaacgacatggtctattcatgctcaccatcagtggatgaccacagaagacatgcttactgtttggaacagggtgtggatcgaggacaatccatggatggaagacaaaactccaattacaacctgggaaaatgttccatacctagggaagagggaagaccaatggtgcggatcacttattggtctcacttccagagcaacctgggcccagaacatacccacagcaattcaacaggtgagaagccttataggcaatgaagagtttctggactacatgccttcaatgaagagattcaggaaggaggaggagtcggagggagccatttggtaa

SEQ ID NO: 7189 - RNA, 9873 nt, synthetic construct
  misc_feature 1..9873: note = derived and/or modified CDS sequence (wt) from DENV-3__KF954947__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagaaatgtgtgatgacacggtcacttacaaatgcccccacattaccgaagtggaacctgaagacattgactgctggtgcaaccttacatcaacatgggtgacttatggaacgtgtaatcaagctggagagcatagacgcgacaagagatcagtggcgttagctccccatgtcggcatgggactggacacacgcacccaaacctggatgtcggctgaaggagcttggagacaagtcgagaaggtagagacatgggcccttaggcatccagggttcaccatactagccctatttcttgcccattacataggcacctccttgacccagaaggtggttatttttatactactaatgctggtcaccccatccatgacaatgagatgtgtgggagtgggaaacagagattttgtggaaggtctgtcaggagctacgtgggttgacgtggtgctagagcacggggggtgtgtgaccaccatggctaagaacaagcccacgctggatatagagcttcagaagaccgaggccacccaactggcgaccctaaggaagctatgcattgaggggaaaattaccaacataacaactgactcaagatgtcccacccaaggggaagcggttttgcctgaggagcaggaccagaactacgtgtgtaagcacacatacgtagatagaggctgggggaacggctgtggtttgttcggcaagggaagcttggtaacatgtgcgaaatttcaatgcctggaaccgatagagggaaaagtagtgcaatatgagaacctcaaatacaccgtcatcattacagtgcacacaggagaccaacaccaggtgggaaatgaaacgcagggaatcacggctgagataacgcctcaggcatcaactactgaagccatcttgcctgaatatggaacccttgggctagaatgctcaccacggacaggtttggacttcaatgaaatgatcttactaacaatgaagaacaaagcatggatggtacacagacaatggttttttgacctacctctaccatggacatcaggagccacaacagaaacaccaacttggaacaggaaggagctccttgtgacattcaaaaatgcacatgcgaaaaaacaagaagtagttgtccttggatcgcaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgatcacagccaacccagtggtgactaagaaggaggagcctgtcaacattgaggctgaacctccttttggggaaagtaatatagtaattggaattggagacaatgccttgaaaatcaattggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtgatgaaaattggaataggtgttctcttaacttggatagggttgaattcaaaaaacacatccatgtcattttcatgcattgcaataggaatcatcacactctatttgggagctgtggtacaagctgacatggggtgtgtcataaactggaaaggcaaagaacttaaatgcggaagtggaattttcgtcaccaacgaggtccatacctggacagagcagtacaaattccaagcggattccccaaaaagattggcgacagctattgtaggtgcttgggaaaatggagtgtgtggaattaggtcaacaaccagaatggagaatctcttgtggaagcaaatagccaatgaactgaactacatattatgggaaaacaacatcaaattaacggtagttgtgggcgacacaatcggggttttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaaatgtgtgaccataggctaatgtcggcagccgtcaaggatgagagggccgtgcatgccgacatgggctactggatagaaagccaaaagaatggaagttggaagctagaaaaagcatccctcatagaggtgaaaacctgcacatggccaaaatcacacactctttggagcaacggtgtgctagagagtgacatgatcattccaaagagtctagctggtcctatttcgcaacacaactacaggcccgggtaccacacccaaacggcaggaccctggcacttaggaaaattggagctggacttcaactattgtgaaggaacaacagttgtcatcacagaaaattgtgggacaagaggcccatcattgagaacgacaacagtgtcaggaaagttgatacatgaatggtgttgccgctcgtgcacacttcctcccctgcgatacatgggagaagacggctgttggtatggcatggaaatcagacccatcagtgagaaagaagagaacatggtaaagtctttagtctcagcgggaagtggaaaggtagacaacttcacaatgggtgtcttgtgtttggcaatcctctttgaagaggtgatgagaggaaaatttgggaagaaacacatgattgcaggggttttcttcacgtttgtgctccttctctcagggcaaataacatggagagacatggcgcacacactaataatgattgggtccaacgcctctgacaggatgggaatgggcgtcacctatctagctttaattgcaacatttaaaatccagccattcctggctttgggatttttcctaagaaaactgacatctagagaaaatttactgttaggagtcggactggctatggcaacaacgttacaattgccagaggacattgaacaaatggcaaatggaatcgccctggggctcatggctcttaaattgataacacaatttgaaacataccaattatggacagcattaatctccttaacgtgttcaaatacaattttcacgttgactgttgcttggagaacagccaccctgattttggccggagtttcacttttaccagtgtgccagtcttcgagcatgagaaaaacagactggcttccaatgacagtggcagctatgggagtcccacccctaccactctttatttttagcttgaaagacacactcaaaaggagaagctggccactgaatgagggggtgatggctgttggacttgtgagcatgctggccagttctctccttagaaatgacgtgcccatggctggaccattagtggccgggggcttgctgatagcgtgctacgtcataactggcacgtcagcagaccttacagtggaaaaagcagcagatgtaacatgggaggaagaggctgagcaaacaggagtgtcccacaacttaatgatcacagttgatgatgatggaacaatgagaataaaagatgatgagactgagaatattctaacagtgcttttgaagacagcattactaatagtatcaggtatctttccatactccataccagcgacattgttggtctggcatacttggcaaaagcaaacccaaagatccggtgttctatgggacgtacccagccccccagagacacagaaagcagaactggaagaaggggtctataggatcaaacagcaaggaattcttgggaaaacccaagtaggggttggagtacaaaaagacggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaatccaaagaacttccaaaccatgccaggcacattccagactacaacaggggaaataggagcaattgcattggatttcaagcctggaacttcagggtctcctatcataaacagagagggaaaggtagtgggactatatggcaatggagtggttacaaagaatggcggctacgtcagcggaatagcgcaaacaaatgcagaaccagatggaccgacgccagagttggaagaagagatgttcaaaaagcgaaatctaaccataatggatcttcatcctgggtcaggaaagacacggaaatatcttccagccattgttagagaggcaatcaagagacgtttaagaactctgattctggcaccgacaagggtggttgcagctgagatggaagaagcattgaaggggctcccaataaggtaccaaacaacagcaacaaaatctgaacatacgggaagagagattgttgatctaatgtgccacgcaacgttcacaatgcgcttgctgtcaccagttagggttccaaattacaacttgataataatggatgaggcccatttcacagacccagccagtatagcggccagagggtacatatcaactcgtgttggaatgggagaggcagccgcaatcttcatgacggcaacgccccctggaacagctgatgcctttcctcagagcaacgctccaattcaagatgaagaaagggacataccagaacgctcatggaattcaggcaatgaatggatcaccgacttcgccgggaaaacggtgtggtttgtccccagcatcaaagccggaaatgacatagcaaactgcttgcgaaagaacgggaaaaaggtcattcaacttagtaggaagacttttgatacagaatatcagaagactaaactaaatgactgggactttgtggtgacaactgacatttcagaaatgggggccaatttcaaagcagatagagtgatcgacccaagaagatgtctaaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgacgaagaccatgctcactggacagaagcaaaaatgctgctggacaacatcaacactccagaaggaatcataccagctctctttgaaccagaaagggagaagtcagccgccatagacggtgaatatcgcctgaagggtgaatccaggaagactttcgtggaactcatgaggaggggtgacctcccagtttggttagcccacaaagtagcatcagaagggatcaaatatacagataggaaatggtgctttgatggacagcgcaacaatcaaattttagaggaaaacatggacgtggaaatctggacaaaggaaggagaaaagaaaaaattaagacctaggtggcttgatgcccgcacttattcagatcccttagcactcaaggaattcaaggactttgcggcaggcagaaagtcaatcgcccttgatcttgtgacagaaataggaagagtgccttcacacctagcccacagaacgagaaacgctctggacaatctggtgatgctgcacacgtcagaacatggcggtagggcctacaggcatgcggtggaggaactaccagaaacaatggaaacactcctactcttgggactcatgatcttactgacaggtggagcaatgcttttcttgatatcaggtaaagggattggaaagacttcaataggactcatttgtgtgattgcttccagcggcatgctgtggatggccgaaattccactccaatggatcgcgtcggctatagtcctggagttttttatgatggtgttgcttataccagaaccagaaaagcagagaaccccccaagacaaccaactcgcatatgtcgtaataggcatacttacaatggctgcaataatagcggccaatgaaatgggactattggaaactacaaagagagatctaggaatgtctaaggaaccaggtgttgtttctccaactagctatttggatgtggatttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactactggcattgggttgctattcacaagtgaacccactgactctaacagcggcagtacttttgctagttacacattatgctattataggtccaggactgcaggcaaaagccactcgtgaagctcaaaaaaggacagctgctggaataatgaagaatccaacggtggatgggataataacaatagacctagaccctgtaatatatgattcaaaatttgaaaagcaactgggacaggtcatgctcctggttttgtgtgcagttcaactgttgttaatgagaacatcatgggccttgtgtgaagctttaactttagctacaggaccaataacaacactctgggaaggatcacctgggaagttttggaataccacgatagctgtttctatggcgaacatttttagagggagctatttagcaggagctgggcttgccttttctattatgaaatcagttggaacaggaaaaagaggaacaggctctcaaggtgaaactttaggagaaaaatggaaaaagaaattgaatcaattatcccggaaagagtttgacctttacaagaagtctggaatcactgaagtggatagaacagaagccaaagaagggttgaaaagaggagaaacaacacatcatgccgtgtccaggggtagtgcaaaacttcaatggtttgtggaaaggaacatggtcattcccgagggaagagtcatagacctgggctgtggaagaggaggctggtcatattactgtgcaggactgaaaaaagtcacagaagtgcgaggatacacaaaaggcggtccaggacacgaagaaccagtgcctatgtcaacatatggatggaacatagttaaattaatgagtggaaaggatgtgttttatcttccgcctgaaaagtgtgacaccctgttgtgtgacattggagaatcttcaccaagcccaacagtggaagaaagcagaactataagagttttgaagatggttgaaccatggctaaaaaacaaccagttttgcattaaagtattgaacccttacatgccagccgtgattgagcacctagaaagactgcaaaggaaacacggaggaatgcttgtgagaaatccactttcacgaaactccacgcacgaaatgtactggatatctaatggtacaggtaacattgtctcttcagttaacatggtatccagattgttactgaacaggttcacgatgacacacaggagacctaccatagagaaagatgtggatttaggagcaggaactcgacatgtcaatgcggaaccagaaacacccaacatggatgtcattggggaaagaataaaaaggatcaaggaggagcataattcaacatggcactatgatgacgaaaacccctacaaaacgtgggcttaccacggatcttatgaagtcaaggccacaggctcagcctcctccatgataaacggagtcgtgaaacttctcactaaaccatgggatgtagtgcccatggtgacacagatggcaatgacagatacaactccatttggccagcagagagtctttaaagagaaggtggacaccaggacacccaggcctatgccagggacaagaaaggttatggagatcacagcggagtggctctggagaaccctgggaaggaacaaaagacccaggttatgcacaagggaagagttcacaaaaaaggtcagaaccaacgcagccatgggcgccgttttcacagaggagaaccaatgggacagtgcgaaagccgctgttgaggatgaagagttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcacacaacgaatggaccctgaacacaggctgttagcgaacgctatatttaagctcacataccaaaacaaagtggtcaaagttcaacgaccgactccaacgggcacggtaatggacattatatctaggaaagaccaaagaggcagtggacaggtgggaacttatggtctgaacacatttactaacatggaagcccagttagtcagacaaatggaaggagaaggtgtgctgtcaaagacagacctcgagaaccctcatctgccagaaaagaaaattacacaatggctggaaaccaaaggagtggagaggttaaaaagaatggccattagcggggatgattgcgtagtgaaaccaatcgatgacaggttcgctaacgcactgcttgccctgaacgatatgggaaaggttcggaaagacatacctcaatggcagccatcaaagggatggcatgactggcagcaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtttggggaaagcctacgcccaaatgtggagtctcatgtattttcacagaagagatctcagactagcgtccaatgccatatgttcagcaataccagtccactgggtccccacaagtagaacgacatggtctattcatgctcaccatcagtggatgaccacagaagacatgcttactgtttggaacagggtgtggatcgaggacaatccatggatggaagacaaaactccaattacaacctgggaaaatgttccatacctagggaagagggaagaccaatggtgcggatcacttattggtctcacttccagagcaacctgggcccagaacatacccacagcaattcaacaggtgagaagccttataggcaatgaagagtttctggactacatgccttcaatgaagagattcaggaaggaggaggagtcggagggagccatttggtaa

SEQ ID NO: 7190 - RNA, 9873 nt, synthetic construct
  misc_feature 1..9873: note = derived and/or modified CDS sequence (wt) from DENV-3__KF954945__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagaaatgtgtgatgacacggtcacttacaaatgcccccacattaccgaagtggaacctgaagacattgactgctggtgcaaccttacatcaacatgggtgacttatggaacgtgtaatcaagctggagagcatagacgcgacaagagatcagtggcgttagctccccatgtcggcatgggactggacacacgcacccaaacctggatgtcggctgaaggagcttggagacaagtcgagaaggtagagacatgggcccttaggcatccagggttcaccatactagccctatttcttgcccattacataggcacctccttgacccagaaggtggttatttttatactactaatgctggtcaccccatccatgacaatgagatgtgtgggagtgggaaacagagattttgtggaaggtctgtcaggagctacgtgggttgacgtggtgctagagcacggggggtgtgtgaccaccatggctaagaacaagcccacgctggatatagagcttcagaagaccgaggccacccaactggcgatcctaaggaagctatgcattgaggggaaaattaccaacataacaactgactcaagatgtcccacccaaggggaagcggttttgcctgaggagcaggaccagaactacgtgtgtaagcacacatacgtagatagaggctgggggaacggctgtggtttgttcggcaagggaagcttggtaacatgtgcgaaatttcaatgcctggaaccgatagagggaaaagtagtgcaatatgagaacctcaaatacaccgtcatcattacagtgcacacaggagaccaacaccaggtgggaaatgaaacgcagggaatcacggctgagataacgcctcaggcatcaactactgaagccatcttgcctgaatatggaacccttgggctagaatgctcaccacggacaggtttggacttcaatgaaatgatcttactaacaatgaagaacaaagcatggatggtacacagacaatggttttttgacctacctctaccatggacatcaggagccacaacagaaacaccaacttggaacaggaaggagctccttgtgacattcaaaaatgcacatgcgaaaaaacaagaagtagttgtccttggatcgcaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgatcacagccaacccagtggtgactaagaaggaggagcctgtcaacattgaggctgaacctccttttggggaaagtaatatagtaattggaattggagacaatgccttgaaaatcaattggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtgatgaaaattggaataggtgttctcttaacttggatagggttgaattcaaaaaacacatccatgtcattttcatgcattgcaataggaatcatcacactctatttgggagctgtggtacaagctgacatggggtgtgtcataaactggaaaggcaaagaacttaaatgcggaagtggaattttcgtcaccaacgaggtccatacctggacagagcagtacaaattccaagcggattccccaaaaagattggcgacagctattgtaggtgcttgggaaaatggagtgtgtggaattaggtcaacaaccagaatggagaatctcttgtggaagcaaatagccaatgaactgaactacatattatgggaaaacaacatcaaattaacggtagttgtgggcgacacaatcggggttttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaaatgtgtgaccataggctaatgtcggcagccgtcaaggatgagagggccgtgcatgccgacatgggctactggatagaaagccaaaagaatggaagttggaagctagaaaaagcatccctcatagaggtgaaaacctgcacatggccaaaatcacacactctttggagcaacggtgtgctagagagtgacatgatcattccaaagagtctagctggtcctatttcgcaacacaactacaggcccgggtaccacacccaaacggcaggaccctggcacttaggaaaattggagctggacttcaactattgtgaaggaacaacagttgtcatcacagaaaattgtgggacaagaggcccatcattgagaacgacaacagtgtcaggaaagttgatacatgaatggtgttgccgctcgtgcacacttcctcccctgcgatacatgggagaagacggctgttggtatggcatggaaatcagacccatcagtgagaaagaagagaacatggtaaagtctttagtctcagcgggaagtggaaaggtagacaacttcacaatgggtgtcttgtgtttggcaatcctctttgaagaggtgatgagaggaaaatttgggaagaaacacatgattgcaggggttttcttcacgtttgtgctccttctctcagggcaaataacatggagagacatggcgcacacactaataatgattgggtccaacgcctctgacaggatgggaatgggcgtcacctatctagctttaattgcaacatttaaaatccagccattcctggctttgggattttttctaagaaaactgacatctagagaaaatttactgttaggagtcggactggctatggcaacaacgttacaattgccagaggacattgaacaaatggcaaatggaatcgccctggggctcatggctcttaaattgataacacaatttgaaacataccaattatggacagcattaatctccttaacgtgttcaaatacaattttcacgttgactgttgcttggagaacagccaccctgattttggccggagtttcacttttaccagtgtgccagtcttcgagcatgagaaaaacagactggcttccaatgacagtggcagctatgggagtcccacccctaccactctttatttttagcttgaaagacacactcaaaaggagaagctggccactgaatgagggggtgatggctgttggacttgtgagcatgctggccagttctctccttagaaatgacgtgcccatggctggaccattagtggccgggggcttgctgatagcgtgctacgtcataactggcacgtcagcagaccttacagtggaaaaagcagcagatgtaacatgggaggaagaggctgagcaaacaggagtgtcccacaacttaatgatcacagttgatgatgatggaacaatgagaataaaagatgatgagactgagaatattctaacagtgcttttgaagacagcattactaatagtatcaggtatctttccatactccataccagcgacattgttggtctggcatacttggcaaaagcaaacccaaagatccggtgttctatgggacgtacccagccccccagagacacagaaagcagaactggaagaaggggtctataggatcaaacagcaaggaattcttgggaaaacccaagtaggggttggagtacaaaaagacggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaatccaaagaacttccaaaccatgccaggcacattccagactacaacaggggaaataggagcaattgcattggatttcaagcctggaacttcggggtctcctatcataaacagagagggaaaggtagtgggactatatggcaatggagtggttacaaagaatggcggctacgtcagcggaatagcgcaaacaaatgcagaaccagatggaccgacgccagagttggaagaagagatgttcaaaaagcgaaatctaaccataatggatcttcatcctgggtcaggaaagacacggaaatatcttccagccattgttagagaggcaatcaagagacgtttaagaactctgattctggcaccgacaagggtggttgcagctgagatggaagaagcattgaaggggctcccaataaggtaccaaacaacagcaacaaaatctgaacacacaggaagagagattgttgatctaatgtgccacgcaacgttcacaatgcgcttgctgtcaccagttagggttccaaattacaacttgataataatggatgaggcccatttcacagacccagccagtatagcggccagagggtacatatcaactcgtgttggaatgggagaggcagccgcaatcttcatgacggcaacgccccctggaacagctgatgcctttcctcagagcaacgctccaattcaagatgaagaaagggacataccagaacgctcatggaattcaggcaatgaatggatcaccgacttcgccgggaaaacggtgtggtttgtccccagcatcaaagccggaaatgacatagcaaactgcttgcgaaagaacgggaaaaaggtcattcaacttagtaggaagacttttgatacagaatatcagaagactaaactaaatgactgggactttgtggtgacaactgacatttcagaaatgggggccaatttcaaagcagatagagtgatcgacccaagaagatgtctaaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgacgaagaccatgctcactggacagaagcaaaaatgctgctggacaacatcaacactccagaaggaatcataccagctctctttgaaccagaaagggagaagtcagccgccatagacggtgaatatcgcctgaagggtgaatccaggaagactttcgtggaactcatgaggaggggtgacctcccagtttggttagcccacaaagtagcatcagaagggatcaaatatacagataggaaatggtgctttgatggacagcgcaacaatcaaattttagaggaaaacatggacgtggaaatctggacaaaggaaggagaaaagaaaaaattaagacctaggtggcttgatgcccgcacttattcagatcccttagcactcaaggaattcaaggactttgcggcaggcagaaagtcaatcgcccttgatcttgtgacagaaataggaagagtgccttcacacctagcccacagaacgagaaacgctctggacaatctggtgatgctgcacacgtcagaacatggcggtagggcctacaggcatgcggtggaggaactaccagaaacaatggaaacactcctactcttgggactcatgatcttactgacaggtggagcaatgcttttcttgatatcaggtaaagggattggaaagacttcaataggactcatttgtgtgattgcttccagcggcatgctgtggatggccgaaattccactccaatggatcgcgtcggctatagtcctggagttttttatgatggtgttgcttataccagaaccagaaaagcagagaaccccccaagacaaccaactcgcatatgtcgtaataggcatacttacaatggctgcaataatagcggccaatgaaatgggactactggaaactacaaagagagatctaggaatgtctaaggaaccaggtgttgtttctccaactagctatttggatgtggatttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactactggcattgggttgctattcacaagtgaacccactgactctaacagcggcagtacttttgctagttacacattatgctattataggtccaggactgcaggcaaaagccactcgtgaagctcaaaaaaggacagctgctggaataatgaagaatccaacggtggatgggataataacaatagacctagaccctgtaatatatgattcaaaatttgaaaagcaactgggacaggtcatgctcctggttttgtgtgcagttcaactgttgttaatgagaacatcatgggccttgtgtgaagctttaactttagctacaggaccaataacaacactctgggaaggatcacctgggaagttttggaataccacgatagctgtttctatggcgaacatttttagagggagctatttagcaggagctgggcttgccttttctattatgaaatcagttggaacaggaaaaagaggaacaggctctcaaggtgaaactttaggagaaaaatggaaaaagaaattgaatcaattatcccggaaagagtttgacctttacaagaagtctggaatcactgaagtggatagaacagaagccaaagaagggttgaaaagaggagaaacaacacatcatgccgtgtccaggggtagtgcaaaacttcaatggtttgtggaaaggaacatggtcattcccgagggaagagtcatagacctgggctgtggaagaggaggctggtcatattactgtgcaggactgaaaaaagtcacagaagtgcgaggatacacaaaaggcggtccaggacacgaagaaccagtgcctatgtcaacatatggatggaacatagttaaattaatgagtggaaaggatgtgttttatcttccgcctgaaaagtgtgacaccctgttgtgtgacattggagaatcttcaccaagcccaacagtggaagaaagcagaactataagagttttgaagatggttgaaccatggctaaaaaacaaccagttttgcattaaagtattgaacccttacatgccagccgtgattgagcacctagaaagactgcaaaggaaacacggaggaatgcttgtgagaaatccactttcacgaaactccacgcacgaaatgtactggatatctaatggtacaggtaacattgtctcttcagttaacatggtatccagattgttactgaacaggttcacgatgacacacaggagacctaccatagagaaagatgtggatttaggagcaggaactcgacatgtcaatgcggaaccagaaacacccaacatggatgtcattggggaaagaataaaaaggatcaaggaggagcataattcaacatggcactatgatgacgaaaacccctacaaaacgtgggcttaccacggatcttatgaagtcaaggccacaggctcagcctcctccatgataaacggagtcgtgaaacttctcactaaaccatgggatgtagtgcccatggtgacacagatggcaatgacagatacaactccatttggccagcagagagtctttaaagagaaggtggacaccaggacacccaggcctatgccagggacaagaaaggttatggagatcacagcggagtggctctggagaaccctgggaaggaacaaaagacccaggttatgcacaagggaagagttcacaaaaaaggtcagaaccaacgcagccatgggcgccgttttcacagaggagaaccaatgggacagtgcgaaagccgctgttgaggatgaagagttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcacacaacaaatggaccctgaacacaggctgttagcgaacgctatatttaagctcacataccaaaacaaagtggtcaaagttcaacgaccgactccaacgggcacggtaatggacattatatctaggaaagaccaaagaggcagtggacaggtgggaacttatggtctgaacacatttactaacatggaagcccagttagtcagacaaatggaaggagaaggtgtgctgtcaaagacagacctcgagaaccctcatctgccagaaaagaaaattacacaatggctggaaaccaaaggagtggagaggttaaaaagaatggccattagcggggatgattgcgtagtgaaaccaatcgatgacaggttcgctaacgcactgcttgccctgaacgatatgggaaaggttcggaaagacatacctcaatggcagccatcaaagggatggcatgactggcagcaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtttggggaaagcctacgcccaaatgtggagtctcatgtattttcacagaagagatctcagactagcgtccaatgccatatgttcagcaataccagtccactgggtccccacaagtagaacgacatggtctattcatgctcaccatcagtggatgaccacagaagacatgcttactgtttggaacagggtgtggatcgaggacaatccatggatggaagacaaaactccaattacaacctgggaaaatgttccatacctagggaagagggaagaccaatggtgcggatcacttattggtctcacttccagagcaacctgggcccagaacatacccacagcaattcaacaggtgagaagccttataggcaatgaagagtttctggactacatgccttcaatgaagagattcaggaaggaggaggagtcggagggagccatttggtaa

SEQ ID NO: 7191 - RNA, 9873 nt, synthetic construct
  misc_feature 1..9873: note = derived and/or modified CDS sequence (wt) from DENV-3__JX669495__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattggaaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcatcacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtggttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggtcattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcagcttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaatttaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagagaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatctaggagcaggaactcgacatgttaatgcggaaccagaaacacccaacatggatgtcattggggaaagaataaaaaggatcaaggaggagcataattcaacatggcactatgatgacgaaaacccctacaaaacttgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaagttacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgactggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7192 - RNA, 9873 nt, synthetic construct
  misc_feature 1..9873: note = derived and/or modified CDS sequence (wt) from DENV-3__JX669499__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggccgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttttgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaattacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggtttggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcctttgcgatacatgggagaagacggttgctggtatggcatggaaatcagacccatcagtgaaaaagaagagaacatggtaaagtctttagtctcagcgggaagtggaaaggtggacaacttcacaatgggtgtcttatgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcattacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcactaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccctagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcggtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagtttgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgactggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7193 - RNA, 9873 nt, synthetic construct
  misc_feature 1..9873: note = derived and/or modified CDS sequence (wt) from DENV-3__JX669492__SS-prME
  source 1..9873: mol_type = other RNA
acatcgttctgtctcatgatgatattgccagcagcacttgctttccacttgacttcacgagatggagagccgcgcatgatagtggggaagaatgaaagaggaaaatccctactttttaagacagcctctggaatcaacatgtgcacactcatagccatggacctgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacccccttttggggaaagtaatatagtgattggaattggagacaacgccttgaaaatcaactggtataagaaaggaagctccattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaacctcctgtggaagcaaatagccaatgaactgaactacatattgtgggaaaacaatatcaaattaacggtggttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctactggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgtcacctacctagctttaattgcaacatttaaaatccagccattcttggctttgggatttttcctaagaaaactgacatccagagaaaatttattgttaggggttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacactgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaaccaaactgaatgattgggacttcgtggtgacaactgacatttcagaaatgggggccaatttcaaagcagatagagtaatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccacaaagtagcatcagaagggatcaaatatacagatagaaaatggtgctttgatggacaacgcaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttctttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgatagagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgatgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaagtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagcctcataggcaatgaagagtttctggactacatgccttcaatgaagagattcaggaaggaggaggagtcggagggagccatttggtaa

SEQ ID NO: 7194 - RNA, 9873 nt, synthetic construct
  misc_feature 1..9873: note = derived and/or modified CDS sequence (wt) from DENV-3__JX669500__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggactatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcgagatgtcctacccaaggggaagcggttttgcctgaggagcaggaccagaactacgtgtgtaagcatacatacgtagacagaggctgggggaacggatgtggtttgtttggcaaaggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcgaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaattatcacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccaggatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaagtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagagtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaatattcatgacagcaacgccccctggaacagctgatgcctttccacagagcaacgctccaattcaagatgaagaaagggacataccagaacgctcatggaattcaggcaatgaatggataaccgactttgctgggaaaacggtgtggtttgtccccagcattaaagccggaaatgacatagcaaactgcttgcgaaaaaatgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgcttcgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggccgcaataatagcagctaatgaaatgggattgttggaaactacaaagagagatttaggaatgtctaaggagccaggtgttgtctctccaaccagctacttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttgggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggcccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagtttgaagcccttggatttttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgccaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttagaaaggaggaggagtcggagggagccatttggtaa

SEQ ID NO: 7195 - RNA, 9873 nt, synthetic construct
  misc_feature 1..9873: note = derived and/or modified CDS sequence (wt) from DENV-3__JX669497__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacctgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgtctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacccccttttggggaaagtaatatagtgattggaattggagacaacgcctcgaaaatcaactggtataagaaaggaagctccattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaacctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctactggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgtcacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacactgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaaccaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccacaaagtagcatcagaagggatcaaatatacagatagaaaatggtgctttgatggacaacgcaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttctttatgatggtgttgctcataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgatgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaagtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccttgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctgggaaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7196 - RNA, 9873 nt, synthetic construct
  misc_feature 1..9873: note = derived and/or modified CDS sequence (wt) from DENV-3__JX669501__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattgacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcccttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgtcctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttgtaaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaattacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagcaatggtgtgctagagagtgacatgatcatcccaaagagtctagctggtcctatttcgcaacacaaccacaggcccgggtaccacacccagacagcgggaccctggcatttaggaaaattagagctggacttcaactattgtgaaggaacaacagttgtcatcacagaaaactgtgggacaagaggcccatcactgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaacaatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggccatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcggaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactactacaggggaaataggagcaattgcactggatttcaagcccggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcgatggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatgtatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacattttcagagggagttatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcatcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtttttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagccggctgggacacaagaataacagaagatgacctgcacaatgaggaaaagatcacacagcaaatggaccctgaacacaggcagttagcgaacgctatatttaaactcacataccaaaacaaagtggtcaaagttcaacgaccgactccaacaggcacggtaatggacatcatatctaggaaagaccaaagaggcagtggacaggtaggaacttatggtctgaatacattcaccaatatggaagcccagttaatcagacaaatggaaggagaaggtgtgctgtcaaaggcagacctcgagaaccctcatctgccagagaagaaaattacacaatggctggaaaccaaaggagtggagaggttaaaaagaatggccattagcggggatgattgcgtagtgaaaccaatcgatgacaggttcgctaatgccctgctcgctctgaacgatatgggaaaggttcgaaaagacatacctcaatggcagccatcaaaaggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttagaaaggaggaggagtcggagggagccatttggtaa

SEQ ID NO: 7197 - RNA, 9873 nt, synthetic construct
  misc_feature 1..9873: note = derived and/or modified CDS sequence (wt) from DENV-3__JX669494__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaaccaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatattactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattgacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgctcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattctggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggagtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggtcattgccgtagagcctggaaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaattgcttgcgaaaaaacgggaaaaaggtcattcagcttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatactcacattggctgcaataatagcagctaatgaaatgggattgctggaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattccacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagccgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacacggtatctagactgctactgaacaggttcacgatgacacacagaagacccaccactgagaaagatgtggatttaggagcaggaactcgacatgttaatgcggaaccagaaacacccaacatggatgtcattggggaaagaataaaaaggatcaaggaggagcataattcaacatggcattatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtttttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagctcttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgactacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7198 - RNA, 9873 nt, synthetic construct
  misc_feature 1..9873: note = derived and/or modified CDS sequence (wt) from DENV-3__JX669503__SS-prME
  source 1..9873: mol_type = other RNA
acatcgttctgtctcatgatgatattgccagcagcacttgctttccacttgacttcacgagatggagagccgcgcatgatagtggggaagaatgaaagaggaaaatccctactttttaagacagcctctggaatcaacatgtgcacactcatagccatggacctgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatctgtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcgaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacccccttttggggaaagtaatatagtgattggaattggagacaacgccttgaaaatcaactggtataagaaaggaagctccattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaacctcctgtggaagcaaatagccaatgaactgaactacatattgtgggaaaacaatatcaaattaacggtggttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctactggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaatcacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgtcacctacctagctttaattgcaacatttaaaatccagccattcttggctttgggatttttcctaagaaaactgacatccagagaaaatttattgttaggggttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacactgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaaccaaactgaatgattgggacttcgtggtgacaactgacatttcagaaatgggggccaatttcaaagcagatagagtaatcgacccaagaagatgtctcaaaccagtgatcctgacagatggaccagagcgggtggtcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccacaaagtagcatcagaagggatcaaatatacagatagaaaatggtgctttgatggacaacgcaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttctttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgatagagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgatgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaagtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccttgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagcctcataggcaatgaagagtttctggactacatgccttcaatgaagagattcaggaaggaggaggagtcggagggagccatttggtaa

SEQ ID NO: 7199 - RNA, 9873 nt, synthetic construct
  misc_feature 1..9873: note = derived and/or modified CDS sequence (wt) from DENV-3__JX669493__SS-prME
  source 1..9873: mol_type = other RNA
acatcgttctgtctcatgatgatattgccagcagcacttgctttccacttgacttcacgagatggagagccgcgcatgatagtggggaagaatgaaagaggaaaatccctactttttaagacagcctctggaatcaacatgtgcacactcatagccatggacctgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacccccttttggggaaagtaatatagtgattggaattggagacaacgccttgaaaatcaactggtataagaaaggaagctccattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaacctcctgtggaagcaaatagccaatgaactgaactacatattgtgggaaaacaatatcaaattaacggtggttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacataggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgtcacctacctagctttaattgcaacatttaaaatccagccattcttggctttgggatttttcctaagaaaactgacatccagagaaaatttattgttaggggttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacactgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaaccaaactgaatgattgggacttcgtggtgacaactgacatttcagaaatgggggccaatttcaaagcagatagagtaatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgaaccagaaagggagaagtcagccgccatagacggtgagtatcgcttgaaaggtgagtccaggaagactttcgtggaactcatgaggaggggtgaccttccagtctggttagcccacaaagtagcatcagaagggatcaaatatacagatagaaaatggtgctttgatggacaacgcaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttctttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgatagagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgatgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaagtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccttgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagattcaggaaggaggaggagtcggagggagccatttggtaa

SEQ ID NO: 7200 - RNA, 9873 nt, synthetic construct
  misc_feature 1..9873: note = derived and/or modified CDS sequence (wt) from DENV-3__JX669504__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaaccaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatattactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattgacaggagccacagaaatccaaaactcaggaggcacaagtatttttgcagggcatttaaaatgtagacttaagatggacaaattggaactcaaggggatgagctatgcaatgtgcacgaataccttcgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgcttgtgctccttctctcagggcaaataacatggagagacatggcgcacacactaataatgattgggtccaacgcatctgacaggatgggaatgggcgttacctacctagctttaattgcaacattcaaaatccagccattcttggctttgggattttttctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattctggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtaagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggtcattgccgtagagcctggaaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgttagcggaatagcgcaaacgaatgcagaaccagatggaccaacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaattgcttgcgaaaaaacgggaaaaaggtcattcagcttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatactcacattggctgcaataatagcagctaatgaaatgggattgctggaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattccacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagccgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacacggtatctagactgctactgaacaggttcacgatgacacacagaagacccaccactgagaaagatgtggatttaggagcaggaactcgacatgttaatgcggaaccagaaacacccaacatggatgtcattggggaaagaataaaaaggatcaaggaggagcataattcaacatggcattatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtttttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagggacctcagactagcatccaacgccatatgttcagcagtaccagtccactgggtccccacaagtagaacgacatggtctattcatgctcaccatcagtggatgactacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7201 - RNA, 9873 nt, synthetic construct
  misc_feature 1..9873: note = derived and/or modified CDS sequence (wt) from DENV-3__JX669506__SS-prME
  source 1..9873: mol_type = other RNA
acatcgttctgtctcatgatgatattgccagcagcacttgctttccacttgacttcacgagatggagagccgcgcatgatagtggggaagaatgaaagaggaaaatccctactttttaagacagcctctggaatcaacatgtgcacactcatagccatggacctgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggtacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagcttacaatggcagactgattacagccaacccagtggtgactaagaaggaggagcctgtcaatattgaggctgaacccccttttggggaaagtaatatagtgattggaattggagacaacgccttgaaaatcaactggtataagaaaggaagctccattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaacctcctgtggaagcaaatagccaatgaactgaactacatattgtgggaaaacaatatcaaattaacggtggttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgtcacctacctagctttaattgcaacatttaaaatccagccattcttggctttgggatttttcctaagaaaactgacatccagagaaaatttattgttaggggttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacactgctggtctggcatacttggcaaaagcaaacccaaagatccggcgttctatgggacgtacccagccccccagagacacagaaagcagaacttgaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagcatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaaccaaactgaatgattgggacttcgtggtgacaactgacatttcagaaatgggggccaatttcaaagcagatagagtaatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccacaaagtagcatcagaagggatcaaatatacagatagaaaatggtgctttgatggacaacgcaataatcaaattttagaggagaacatggatgtggaaatctggacaaaggaaggagaaaagaaaaaattgagacctaggtggcttgatgcccgcacttattcagatcccttagcactcaaggaatttaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttctttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtaatagagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgttattggggaaagaataaaaaggatcaaggaggagcataattcaacatggcactatgatgatgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaagtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttggcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagatcaatggtgcggatcacttattggtctcacttccagagcaacctgggcccagaacatacccacagcaattcaacaggtgagaagccttataggcaatgaagagtttctggactacatgccttcaatgaagagattcaggaaggaggaggagtcggagggagccatttggtaa

SEQ ID NO: 7202 - RNA, 9873 nt, synthetic construct
  misc_feature 1..9873: note = derived and/or modified CDS sequence (wt) from DENV-3__JX669496__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaaccaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatattactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattgacaggagccacagaaatccaaaactcaggaggcacaagtatttttgcagggcatttaaaatgtagacttaaaatggacaaattggaactcaaggggatgagctatgcaatgtgcgcgaataccttcgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgatatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgctcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattctggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggagtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggtcattgccgtagagcctggaaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaattgcttgcgaaaaaacgggaaaaaggtcattcagcttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatactcacattggctgcaataatagcagctaatgaaatgggattgctggaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattccacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacgtcatgggccttgtgtgaagctttaactctagctacaggaccaataacaacactctgggaaggatcacctgggaagttttggaacaccacgatagccgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacacggtatctagactgctactgaacaggttcacgatgacacacagaagacccaccactgagaaagatgtggatttaggagcaggaactcgacatgttaatgcggaaccagaaacacccaacatggatgtcattggggaaagaataaaaaggatcaaggaggagcataattcaacatggcattatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtttttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagctcttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgactacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7203 - RNA, 9873 nt, synthetic construct
  misc_feature 1..9873: note = derived and/or modified CDS sequence (wt) from DENV-3__JX669490__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgtctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattgacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagaccctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtttttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7204 - RNA, 9873 nt, synthetic construct
  misc_feature 1..9873: note = derived and/or modified CDS sequence (wt) from DENV-3__JN406515__SS-prME
  source 1..9873: mol_type = other RNA
acatcgctctgtctcatgatgatgttaccagcaacacttgctttccacttgacttcacgagatggagagccgcgcatgattgtggggaagaatgaaagaggaaaatccctactttttaagacagcctctggaatcaacatgtgcacactcatagctatggatttgggagaaatgtgtgatgacacggtcacttacaaatgccccctcattactgaagtggagcctgaagacattgactgctggtgcaacctcacatcgacgtgggtgacctacggaacgtgcaaccaagctggagagcatagacgcgataagagatcggtggcgttagctcctcatgtcggcatgggactggacacacgcgcccaaacctggatgtcggctgaaggagcttggagacaagtcgagaaggtagaaacatgggcttttagacacccagggttcacaatactagccctatttcttgcccactacataggcacttccttgacccagaaagtggtcattttcatactactaatgctggtcaccccatccatgacaatgagatgtgtgggagtaggaaacagagatttcgtggaaggtctatcaggagctacatgggttgacgtggtgctcgaacatggtgggtgtgtgactaccatggctaagaacaagcccacgctggacatagagctccagaagaccgaggccacccaactggcaaccctaaggaaactatgcattgagggaaaaatcaccaacgtgacaaccgactcaaggtgccccacccaaggggaagcgattctacctgaggagcaagaccagaactacgtgtgtaagcacacatacgtggacagaggctggggaaacggttgtggtttgtttggcaagggaagtttggtaacatgcgcgaaatttcaatgtctggaattaatagagggaaaagtggttcagcatgagaacctcaaatacaccgtcatcatcacagtgcatacaggagaccaacaccaggtgggaaatgaaacgcagggagtcacggctgaaataacaccccaggcatcaaccgtcgaagccatcttacctgaatatggaacccttgggctagaatgctcaccacggacaggtttggatttcaatgaaatgatcttgttgacaatgaagaacaaagcatggatggtgcatagacaatggttttttgacctacctctaccatggacatcaggggctacaacagaaacaccaacctggaataagaaagagcttcttgtgacattcaaaaacgcacacgcaaaaaaacaagaagtagtagtccttggatcgcaagagggagcaatgcacacagcactgacaggagctacagagatccaaacctcgggaggcacaagtatctttgcgggacacttgaaatgcagactcaagatggacaaactggaactcaaggggatgagctatgcaatgtgctcaaatgcctttgtgttgaagaaagaagtctctgaaacacaacatgggacaatactcattaaggtcgagtacaaaggggaagacgcaccttgcaagatccctttctccacggaggatgaacaagggaaagcccacaatggcagactgatcacggctaacccagtggtgaccaagaaggaagagcctgtcaatattgaggcagaacccccttttggggaaagtaacataataattggaattggagacaaagccttgaaaatcaattggtacaagaagggaagctcgattgggaagatgttcgaggccactgccaggggtgcaaggcgcatggccatcttgggagacacagcctgggactttggatcagtaggtggtgttttaaattcactggggaaaatggtgcaccaaatatttggaagtgcttacacggccctttttagtggagtctcctggataatgaaaattggaataggtgtccttttaacttggatagggttgaattcaaaaaacacttctatgtcattttcatgcattgtgataggaatcatcacactctatctgggagccgtggtgcaagctgacatggggtgtgtcataaattggaaaggcaaagaactcaaatgtggaagtggaattttcgttactaatgaggtccacacttggacagagcaatacaaatttcaagcagactcccccaaaagactggcgacagccattgcaggcgcctgggagaatggagtgtgcggaatcaggtcgacaaccagaatggagaacctcttgtggaagcaaatagctaatgaactaaactacatattatgggaaaacaacatcaaattaacggtagttgtgggtgacataattggggtcttagaacaagggaaaagaacactaacaccacaacccatggagctaaaatattcatggaaaacatggggaaaagcgaaaatagtgacagctgaaacacaaaattcctcctttataatagatgggccaaacacaccagagtgtccaaatgcctcaagagcatggaatgtgtgggaggtggaagattacgggttcggagtcttcacaactaatatatggctgaagctccgagagatgtacactcaactatgtgaccacaggctaatgtcggcagccgttaaggatgagagagccgtacacgccgacatgggctattggatagaaagccaaaagaatggtagttggaagctagaaaaggcatctctcatagaggtaaaaacctgcacatggccaaaatcacacactctctggagcaatggtgtgttggagagtgacatgatcatcccaaagagtctggctggtcctatctcgcaacacaactacaggcctggataccacacccaaacggcaggaccctggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacacttcctcccctgcgatatatgggagaagatggctgctggtatggcatggaaattagacccattaatgagaaagaagagaacatggtaaagtctttagtctcagcagggagtggaaaggtggataacttcacaatgggcgtcctgtgtcttgcaatcctcttcgaagaggtaatgagagggaaattcggaaaaaagcacatgattgcaggggttctcttcacatttgtgctcctcctctcagggcaaataacatggagagacatggcgcgcacactcataatgattggatccaacgcctctgacagaatgggaatgggcgtcacttacctagcattgattgcaacatttaaaattcagccatttttggctttgggattcttcctgaggaaactgacatctagagaaaatttattattgggggttgggttggccatggcaacaacgttgcaactgccagaggacgttgaacaaatggcgaatggaatagccttggggctcatggctcttaaattgataacacaatttgaaacataccaactatggacggcattagtctccctaatgtgttcaaacacaattttcacgttgactgttgcctggagaacagccaccctgattttggccggaatttcgctttttccagtgtgccagtcttcgagcatgaggaaaacagattggctcccaatgactgtggcagctatgggagttccacctttaccactttttattttcagtttgaaagacacactcaaaaggagaagctggccactgaatgagggggtgatggccgttggacttgtgagtatcctagcaagttctctccttaggaatgacgtacccatggctggaccattagtggctgggggcttgctgatagcgtgctacgtcataactggcacgtcagcagacctcactgtagaaaaagcagcggatgtgacatgggaggaagaagctgagcaaacaggagtgtcccacaatctaatgatcacagttgatgatgatggaacaatgagaataaaagatgatgagactgagaacatcttaacagtgcttttgaaaacagcactactaatagtgtcaggcatttttccatactccatacctgcaacacttctggtttggcacacttggcaaaagcaaacccaaagatccggcgtcctgtgggacgtacccagccccccagagacacagaaagcagaactggaagaaggggtctataggatcaagcagcaaggaatttttggaaagacccaagtgggggttggagtacaaaaagaaggagttttccacactatgtggcacgtcacaagaggagcagtgttgacatacaatggaaaaagattggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggactttaagcctggaacttcaggatctcctatcataaacagagagggaaaggtagtgggactatatggcaatggagtggttacaaagaatggtggctatgtcagtggaatagctcaaacaaacgcagaaccagacggaccgacaccagagttggaagaagagatgttcaaaaagcgcaatctaaccatgatggatctccatcccgggtcaggaaagacgcggaaatacctcccagccatagttagagaggcaatcaagagacgcttaaggactctaattttggcaccaacaagggtggttgcagctgagatggaagaagcactgaaagggctcccaataaggtatcaaacaaccgcaacaaaatctgaacacacagggaaagagattgttgatctaatgtgccacgcaacgttcacaatgcgtttgctgtcaccagtcagagttccaaactacaacttgataataatggatgaggctcatttcacagacccagccagtatagcagctagagggtacatatcaactcgtgtaggaatgggagaggcagccgcaattttcatgacggccacacctcctggaacagctgatgcctttcctcagagcaacgctccaattcaagatgaagaaagagacataccagaacgctcatggaattcaggcaatgattggattaccgactttgctggaaagactgtgtggtttgtccccagcatcaaagctgggaatgacatagcaaactgcttgcggaaaaatggaaaaaaggtcattcaacttagtaggaaaacttttgacacagaatatcaaaagactaaactaaatgattgggactttgtggtgacaacagacatttcagaaatgggagccaatttcaaagcagacagagtgatcgacccaagaagatgtctcaagccagtcattttgacggacggacccgagcgcgtgatcctggcgggaccaatgccagtcaccgtagcgagtgctgcgcaaaggagagggagagttggcagaaacccacaaaaagaaaatgaccaatacatattcacgggccagcccctcaacaatgatgaagaccacgctcactggacagaagcgaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattctagaggaaaatatggatgtggaaatctggacaaaggaaggagaaaagaaaaaattgaggcctaggtggcttgatgcccgcacttattcagatcccttagcgctcaaagaattcaaggactttgcggctggtagaaagtcgatcgcccttgatcttgtgacagaaataggaagagtgccttcacatctagcccacagaacgagaaacgctctggacaatctggtgatgttgcacacatcagaacacggtgggagggcctacaggcatgcagtggaggaattaccagaaacaatggaaacactcttactcctgggactcatgatcctgttaacaggtggggcgatgctcttcttgatatcaggcaaaggggttggaaagacttcaataggactcatttgtgtagttgcttccagcggcatgttatggatggctgatatcccactccaatggatcgcgtcggccatagtcctggagttctttatgatggtgttacttataccagaaccagaaaaacagagaactccccaagacaatcaactcgcatatgtcgtgataggcatacttacattggctgcaatagtagcagccaatgaaatgggattgttggaaaccacaaagagagatttggggatgtccaaagaaccaggtgttgtttcgccaaccagttatttggatgtggatttacacccagcatcagcctggacattgtacgctgtggccacaacagtaataacaccaatgttgagacataccatagagaattccacagcaaatgtgtccctagcagctatagccaaccaggcagtggtcctgatgggtttagacaaaggatggccgatatcgaaaatggacttaggcgtgccactattggcactgggttgctattcacaagtgaacccactaactctcacagcggcagtactcctgctagtcacgcattatgctattataggtccaggattgcaggcaaaagctactcgtgaggctcaaaaaaggacggctgctggaataatgaagaatccaacggtggatgggataatgacaatagacctagatcctgtaatatacgactcaaaatttgaaaaacaactaggacaagttatgctcctggttctgtgtgcagttcaacttttgttaatgagaacatcatgggcattttgtgaagctctaaccctagccacaggaccaataacaacactctgggaaggatcacctgggaagttctggaacaccacgatagctgtttccatggcaaacatctttagagggagctatctggcaggagctgggctagctttttctatcatgaaatcagttggaacaggaaagagaggaacagggtcacaaggtgaaactttgggagaaaagtggaaaaagaaactgaatcaattatcccggaaagagtttgacctctacaagaaatccggaatcactgaagtggatagaacagaagccaaagaagggttgaaaagaggagaaataacacaccatgccgtatccagaggcagcgcaaaactccaatggttcgtggagagaaacatggtcattcctgaaggaagagtcatagacttgggctgtggaagaggaggctggtcatattactgtgcaggattgaaaaaagttacagaagtgcgaggatacacaaaaggcggcccaggacatgaagaaccagtacctatgtctacatatggatggaacatagtcaagctgatgagtggaaaggatgtgttttatcttccacctgaaaagtgtgacactctattgtgtgacattggagaatcttcaccaagcccaacagtggaagagagcagaaccataagagtcttgaaaatggttgaaccatggctaaaaaataaccagttttgcattaaagtattgaatccttatatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacatataggagacccaccatagagaaagatgtggatttaggagcggggacccgacatgtcaatgcggaaccagaaacacccaacatggatgtcattggggaaagaataagaagaatcaaggaggagcacagttcaacatggcactatgatgatgaaaatccttacaaaacgtgggcttaccatggatcttatgaagttaaggccacaggctcagcctcctccatgataaatggagtcgtgaaactcctcacgaaaccatgggatgtggtgcccacggtgacacagatggcaatgacggacacaaccccttttggccagcaaagggttttcaaagagaaagtggacaccaggacacccaaacccatgccaggaacaagaaaggttatggagatcacagcggaatggctttggagaaccctgggaaggaacaaaagacccagattatgcacgagagaggagttcacaaaaaaggtcagaaccaacgcagctatgggcgccgtattcacggaggagaaccaatgggacagcgctagagccgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccactggttctcgcgtgaaaactcttacagtggagtagaaggggaaggactgcataagctgggatatatcttgagagatatttccaagatacctggaggagccatgtatgctgatgacacagctgggtgggacacaagaataacagaagatgacctgcacaatgaggaaaaaatcacacagcaaatggaccctgaacacaggcagttagcaaacgctatatttaagctcacataccaaaataaagtggtcaaagttcaacgaccaactccaaagggcacggtaatggacatcatatctaggaaagaccaaagaggcagtggacaggtgggaacttatggtctgaatacattcaccaacatggaagcccagctgatcagacaaatggaaggagaaggtgtgttgtcgaagacagacctcgagaaccctcatctactagagaagaaaattacacaatggttggaaaccaaaggagtggagaggttaaaaagaatggccatcagcggggatgattgcgtggtgaaaccaatcgacgacaggttcgctaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtagtcccctgcagacctcaggatgaattgatagggagagcgagaatctctcagggagcaggatggagccttaaagaaactgcatgcctagggaaagcctacgcccaaatgtgggctctcatgtattttcacagaagagatcttagactagcatccaacgccatatgttcagcagtaccagtccattgggtccccacaagcagaacgacgtggtccatccatgctcaccatcagtggatgactacagaagatatgcttactgtttggaacagggtatggatagaggacaatccatggatggaagacaaagctccagtcacaacttgggaagatgttccatatctagggaagagagaggaccaatggtgcggatcactcattggtctcacttccagagcaacctgggcccagaacatacttaccgcaatccaacaggtaagaagccttataggtaatgaagagtttctggactacatgccttctatgaagagattcaggaaggaggaggagtcagagggagccatttggtaa

SEQ ID NO: 7205 - RNA, 9873 nt, synthetic construct
  misc_feature 1..9873: note = derived and/or modified CDS sequence (wt) from DENV-3__JN406514__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttatggaacgtgcaaccaagctggggagcacagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaagcaattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaagaacaaagcctggatggtacataggcaatggttccttgacctacccctaccatggacatcaggagctacaacagagagaccaacttggaacaggaaagagcttcttgtaacattcaaaaatgcacatgcgaaaaagcaagaagtagttgtccttggatcacaagagggagcaatgcacacagcgctgacaggagctacagagattcaaaactcaggaggtacaagcatttttgcggggcacttgaaatgtagacttaagatggacaaattggaactcaaggggatgagctatgcaatgtgtttgaatacctttgtgttgaagaaagaagtctccgaaacgcagcatgggacaatactcattaaggttgagtacaaaggggaagatgcaccttgcaagatccctttctccacagaggatggacaagggaaagcccacaatggtagactgatcacagccaacccagtggtgaccaagaaggaggagcctgtcaatattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattaggaaaaatggtgcaccaaatattcggaagtgcttacacagccctgtttagcggagtctcatggataatgaaaattggaataggtgtcctcttaacctggatagggctgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacacaattggggtcttagagcaagggaaaagaacactaacaccacagcccatggagctaaaatactcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttctcaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacttgtatttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggacttcaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaaatctttagtctcagcagggagtggaaaagtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgctcttgccactgtgccagtcttcgagcatgaggaaaacagattggctcccaatgactgtggcagctatgggagttccacccttaccactttttattttcagcttgaaggacacacccaaaaggagaagctggccactgaatgagggagtgatggctgttgggcttgtgagcattctagctagttctctccttaggaatgatgtgcccatggctggaccattagtggccgggggcttgttgatagcgtgctatgtcataactggcacgtcagcagacctcactgtagaaaaagcagcagatgtaacatgggaggaagaggctgagcaaacaggggtatcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggatgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaaaggagaggaggtgcaggttattgccgtagagcctgggaagaacccaaaaaactttcaaaccatgccgggcatttttcagacaacaacaggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgaaatggaagaagcactgaaaggactcccaataaggtatcaaacaaccgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggacattccggaacgctcatggaattcaggcaatgaatggattaccgactttgttgggaagacggtgtggtttgtccctagcatcaaagccggaaatgacatagcaaactgcctgcgaaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacctgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagagagaagtcagccgctatagacggtgaataccgcctaaagggtgagtccaggaagaccttcgtggaactcatgaggaggggtgacctcccagtttggctagcccacaaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactgccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcatcggctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgaccctcacagcggcagtacttctgctagtcacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctgaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagagtcttcaccaagcccaacagtggaagaaagcagaactataagagttttgaagatggttgagccatggctaaaaaacaaccagttttgcattaaagtattaaacccttacatgccaaccgtgattgagcacctagaaagactacaaagaaaatatggaggaatgcttgtgagaaacccactctcacgaaactccacgcatgaaatgtactggatatccaatggtaccggcaacattgtctcttcagtcaacatggtatccagattgctactgaacagattcacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagacacaactccatttgggcagcaaagagttttcaaagagaaagtggacaccaggacacctaggcccatgccagggacaagaaaggtcatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattaggcaagtgtggaagctgcgtctacaacatgatgggcaagagagagaagaaacttggagagtttggcaaagcaaaaggcagtagagctatatggtacatgtggttaggagccaggtaccttgagttcgaagcactcgggtttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacaaacaattagcgaacgccatatttaagctcacataccaaaacaaagtggtcaaagtccaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttagaaaccaaaggagtggagagattaaaaagaatggccatcagcggggatgattgcgtggtgaaaccgatcgatgacaggtttgccaatgccctgcttgccctgaatgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttaccgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7206 - RNA, 9873 nt, synthetic construct
  misc_feature 1..9873: note = derived and/or modified CDS sequence (wt) from DENV-3__KT726340__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtgcccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaggatgatgagactgagaatatcttaacagtgcttttgaaaacagcattactaatagtatcaggaatctttccatactccatacccgcaacattgttggtctggcacacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtgattacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgagaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaatatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtggttgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggtaagtgtggaagctgtgtttacaacatgatgggcaagagagagaagaaacttggagagtttggcaaagcaaaaggcagtagagctatatggtacatgtggttgggagccaggtaccttgagttcgaagccctcggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcgtctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccaatcacaacctgggaaaatgttccatatctagggaagagagaagaccaatggtgcggatcactcattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7207 - RNA, 9873 nt, synthetic construct
  misc_feature 1..9873: note = derived and/or modified CDS sequence (wt) from DENV-3__KT726345__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagctccagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgacaaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaagaacacatctatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattatgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgatcttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctcttcttagaaatgatgtacccatggctggaccattagtggccgggggcttgctgatagcgtgctacgtcataactggcacgtcagcagacctcaccgtagaaaaagcagcagatataatatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatttttccatactccatacccgccacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacacataatgggaaaagactggaaccaaactgggctagcgtgaaaaaagatctgatttcatacggaggaggatggagattgagcgcacaatggcaaaagggagaggaggtgcaggttattgccgtagagcctgggaagaacccaaagaactttcaaaccatgccaggcacttttcagactacaacaggagaaataggggcaattgcactggatttcaagcctggaacttcaggatctcctatcataaacagagagggaaaggtagtgggactgtatggtaatggagtggttacaaagaatggtggctacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacacaccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgccattataggtccaggattgcaggcaaaagccactcgtgaggctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaggtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttaggagccaggtacctcgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgctctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7208 - RNA, 9873 nt, synthetic construct
  misc_feature 1..9873: note = derived and/or modified CDS sequence (wt) from DENV-3__KT726349__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagctccagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgacaaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaagaacacatctatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgatcttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctcttcttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagagtatcctaacagtgcttttgaaaacagcattactaatagtatcaggaatttttccatactccatacccgccacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacacataatgggaaaagactggaaccaaactgggctagcgtgaaaaaagatctgatttcatacggaggaggatggagattgagcgcacaatggcaaaagggagaggaggtgcaggttattgccgtagagcctgggaagaacccaaagaactttcaaaccatgccaggcacttttcagactacaacaggagaaataggggcaattgcactggatttcaagcctggaacttcaggatctcctatcataaacagagagggaaaggtagtgggactgtatggtaatggagtggttacaaagaatggtggctacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgccattataggtccaggattgcaggcaaaagccactcgtgaggctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtacctcgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7209 - RNA, 9873 nt, synthetic construct
  misc_feature 1..9873: note = derived and/or modified CDS sequence (wt) from DENV-3__KT726347__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagctccagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctagcaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgacaaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaagaacacatctatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgatcttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctcttcttagaaatgatgtacccatggctggaccattagtggccgggggcctgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatttttccatactccatacccgccacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacacataatgggaaaagactggaaccaaactgggctagcgtgaaaaaagatctgatttcatacggaggaggatggagattgagcgcacaatggcaaaagggagaggaggtgcaggttattgccgtagagcctgggaagaacccaaagaactttcaaaccatgccaggcacttttcagactacaacaggagaaataggggcaattgcactggatttcaagcctggaacttcaggatctcctatcataaacagagagggaaaggtagtgggactgtatggtaatggagtggttacaaagaatggtggctacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtaatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgccattataggtccaggattgcaggcaaaagccactcgtgaggctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaagttaaatcaattatcccggaaagagtttgacctttacaagaaatctggaatcaccgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttgggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttaggagccaggtacctcgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7210 - RNA, 9873 nt, synthetic construct
  misc_feature 1..9873: note = derived and/or modified CDS sequence (wt) from DENV-3__KT726352__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagctccagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgacaaagaaggaggagcctgtcaatattgaggctgaacctccttttggggaaagtaatatagtgattggaattggagataacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaagaacacatctatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgatcttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctcttcttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatttttccatactccatacccgccacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacacataatgggaaaagactggaaccaaactgggctagcgtgaaaaaagatctgatttcatacggaggaggatggagattgagcgcacaatggcaaaagggagaggaggtgcaggttattgccgtagagcctgggaagaacccaaagaactttcaaaccatgccaggcacttttcagactacaacaggagaaataggggcaattgcactggatttcaagcctggaacttcaggatctcctatcataaacagagagggaaaggtagtgggactgtatggtaatggagtggttacaaagaatggtggctacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgctgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgccattataggtccaggattgcaggcaaaagccactcgtgaggctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccgccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtacctcgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7211 - RNA, 9873 nt, synthetic construct
  misc_feature 1..9873: note = derived and/or modified CDS sequence (wt) from DENV-3__KT726356__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagctccagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgacaaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaagaacacatctatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcactatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgatcttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctcttcttagaaatgatgtacccatggctggaccattactggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatttttccatactccatacccgccacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacacataatgggaaaagactggaaccaaactgggctagcgtgaaaaaagatctgatttcatacggaggaggatggagattgagcgcgcaatggcaaaagggagaggaggtgcaggttattgccgtagagcctgggaagaacccaaagaactttcaaaccatgccaggcacttttcagactacaacaggagaaataggggcaattgcactggatttcaagcctggaacttcaggatctcctatcataaacagagagggaaaggtagtgggactgtatggtaatggagtggttacaaagaatggtggctacgtcagcggaatagcacagacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgccattataggtccaggattgcaggcaaaagccactcgtgaggctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacatacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtacctcgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7212 - RNA, 9873 nt, synthetic construct
  misc_feature 1..9873: note = derived and/or modified CDS sequence (wt) from DENV-3__KT726342__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagctccagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgacaaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaagaacacatctatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgatcttggccggagtttcgctcttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctcttcttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttctgaaaacagcattactaatagtatcaggaatttttccatactccatacccgccacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacacataatgggaaaagactggaaccaaactgggctagcgtgaaaaaagatctgatttcatacggaggaggatggagattgagcgcacaatggcaaaagggagaggaggtgcaggttattgccgtagagcctgggaagaacccaaagaactttcaaaccatgccaggcacttttcagactacaacaggagaaataggggcaattgcactggatttcaagcctggaacttcaggatctcctatcataaacagagagggaaaggtagtgggactgtatggtaatggagtggttacaaagaatggtggctacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagctagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgccattataggtccaggattgcaggcaaaagccactcgtgaggctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtacctcgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgatacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7213 - RNA, 9873 nt, synthetic construct
  misc_feature 1..9873: note = derived and/or modified CDS sequence (wt) from DENV-3__KT726343__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagctccagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgacaaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaagaacacatctatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgactgccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgcccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgatcttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctcttcttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatttttccatactccatacccgccacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacacataatgggaaaagactggaaccaaactgggctagcgtgaaaaaagatctgatttcatacggaggaggatggagattgagcgcacaatggcaaaagggagaggaggtgcaggttattgccgtagagcctgggaagaacccaaagaactttcaaaccatgccaggcacttttcagactacaacaggagaaataggggcaattgcactggatttcaagcctggaacttcaggatctcctatcataaacagagagggaaaggtagtgggactgtatggtaatggagtggttacaaagaatggtggctacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgccattataggtccaggattgcaggcaaaagccactcgtgaggctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaagagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtacctcgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7214 - RNA, 9873 nt, synthetic construct
  misc_feature 1..9873: note = derived and/or modified CDS sequence (wt) from DENV-3__KT726351__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagctccagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgacaaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaagaacacatctatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgatcttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctcttcttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatttttccatactccatacccgccacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacacataatgggaaaagactggaaccaaactgggctagcgtgaaaaaagatctgatttcatacggaggaggatggagattgagcgcacaatggcaaaagggagaggaggtgcaggttattgccgtagagcctgggaagaacccaaagaactttcaaaccatgccaggcacttttcagactacaacaggagaaataggggcaattgcactggatttcaagcctggaacttcaggatctcctatcataaacagagagggaaaggtagtgggactgtatggtaatggagtggttacaaagaatggtggctacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgccattataggtccaggattgcaggcaaaagccactcgtgaggctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacgtatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaaaggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtacctcgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7215 - RNA, 9873 nt, synthetic construct
  misc_feature 1..9873: note = derived and/or modified CDS sequence (wt) from DENV-3__KT726360__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagctccagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgacaaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaagaacacatctatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgatcttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctcttcttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatttttccatactccatacccgccacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacacataatgggaaaagactggaaccaaactgggctagcgtgaaaaaagatctgatttcatacggaggaggatggagattgagcgcacaatggcaaaagggagaggaggtgcaggttattgccgtagagcctgggaagaacccaaagaactttcaaaccatgccaggcacttttcagactacaacaggagaaataggggcaattgcactggatttcaagcctggaacttcaggatctcctatcataaacagagagggaaaggtagtgggactgtatggtaatggagtggttacaaagaatggtggctacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggacccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgccattataggtccaggattgcaggcaaaagccactcgtgaggctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtacctcgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7216 - RNA, 9873 nt, synthetic construct
  misc_feature 1..9873: note = derived and/or modified CDS sequence (wt) from DENV-3__KF041259__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaacgaagtggaacctgaagacattgactgctggtgcaaccttacatcaacatgggtgacttatggaacgtgcaatcaagctggagagcatagacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagccctatttcttgcccattacataggcacctccttgacccagaaggtggttatttttatactactaatgctggtcaccccatccatgacaatgagatgtgtgggagtgggaaacagagattttgtggaaggtctgtcaggagctacgtgggttgacgtggtgctagagcacggggggtgtgtgaccaccatggctaagaacaagcccacgctggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggttgtggtttgtttggcaagggaagcttggtaacatgtgcgaagtttcaatgcctggaaccgatagagggaaaagtggtgcaatatgagaacctcaaatacaccgtcatcattacagtgcacacaggagaccaacaccaggtgggaaatgaaacgcagggagtcacggctgagataacgcctcaggcatcaactactgaagccatcttgcctgaatatggaacccttgggctagaatgctcaccacggacaggtttggatttcaatgaaatgatcttactaacaatgaagaacaaagcatggatggtacacagacaatggttttttgacctacctctaccatggacatcaggagctacaacagaaacaccaacttggaacaggaaggagctccttgtgacattcaaaaatgcacatgcgaaaaaacaagaagtggttgtccttggatcgcaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgatcacagccaacccagtggtgactaagaaggaggagcctgttaacattgaggctgaacctccttttggggaaagtaatatagtaattggaattggagacaatgctttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtgatgaaaattggaataggtgttctcttgacttggatagggttgaattcaaaaaacacatccatgtcattttcatgcattgcgataggaatcatcacactctacctgggagctgtggtacaagctgacatggggtgtgtcataaactggaaaggcaaagaacttaaatgtggaagtggaattttcgtcaccaacgaggtccatacctggacagagcagtacaaattccaagcggattccccaaaaagattggcgacagctattgcaggcgcttgggaaaatggagtgtgcggaattaggtcaacaaccagaatggagaatctcttgtggaagcaaatagccaatgaactcaactacatattatgggaaaacaatatcaaattaacggtagttgtgggcgacacaattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccagagtgtccaagtgcctcaagagcatggaatgtgtgggaggtggaagattacgggttcggagtcttcacaaccaacatatggctgaaactccgagaggtgtacacccaaatgtgtgaccataggctaatgtcggcagccgtcaaggatgagagggccgtgcatgccgacatgggctattggatagaaagccaaaagaatggaagttggaagctagaaaaagcatccctcatagaggtgaaaacctgcacatggccaaaatcacacactctttggagcaacggtgtgctagagagtgacatgatcattccaaagagtctagctggtcctatttcgcaacacaactacaggcccgggtaccacacccaaacggcaggaccctggcacttaggaagattggagctggacttcaactattgtgaaggaacaacagttgtcatcacagaaaactgtgggacaagaggcccatcattgagaacgacaacagtgtcaggaaagttgatacacgaatggtgttgccgctcgtgcacacttcctcctctgcgatacatgggagaagacggctgttggtatggcatggagatcagacccatcagtgagaaagaagagaacatggtaaagtctttagtctcagcgggaagtggaaaggtagacaatttcacaatgggtgtcttgtgtttggcaatcctctttgaagaggtgatgagaggaaaatttgggaagaaacacatgattgcaggggttttcttcacgtttgtgctccttctctcagggcaaataacatggagagacatggcgcacacactaataatgattgggtccaacgcctctgacaggatgggaatgggcgtcacctatctagctttaattgcaacatttaaaatccagccattcctggctttaggatttttcctaagaaaactgacatctagagaaaatttactgttaggagttggactggctatggcaacaacattacaactgccagaggacattgaacaaatggcaaatggaatcgccctggggctcatggctcttaaattgataacacaatttgaaacatatcaattatggacggcattaatctccttaacgtgttcaaatacaattttcacgttgactgttgcctggagaacagccaccctgattttggccggagtttcacttttaccagtgtgccagtcttcgagcatgaggaaaacagactggcttccaatgacagtggcagccatgggagtcccacccctaccactctttatttttagcttgaaagacacactcaaaaggagaagctggccgctgaatgaaggggtgatggctgttgggcttgtgagcattttggccagttctctccttagaaatgacgtgcccatggctggaccattagtggccgggggcttgctgatagcatgctacgtcataactggcacgtcagcagaccttacagtagaaaaagcagcagatgtaacatgggaggaagaggctgagcaaacaggagtgtcccacaacttaatgatcacagttgatgatgatggaacaatgagaataaaagatgatgagactgagaatattctaacagtgcttttgaagacagcattactaatagtatcaggtatctttccatactccatacccgcaacattgttggtctggcatacttggcaaaagcaaacccaaagatccggtgtcctatgggacgtacccagtcccccagagacacagaaagcagaactggaggaaggggtctataggatcaaacagcaaggaattcttgggaaaacccaagtaggggttggagtacaaaaagaaggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacatttcagactacaacaggggaaataggagcaattgcactggatttcaagcctggaacttcagggtctcctatcataaacagagagggaaaggtagtgggactatatggcaatggagtggttacaaagaatggcggctacgtcagcggaatagcgcaaacaaatgcagaaccagatggaccgacgccagagttggaagaagagatgttcaaaaaacgaaatctaaccataatggatcttcatcctgggtcaggaaagacacggaaataccttccagccattgttagagaggcaatcaagagacgtttaagaactctaattttggcaccgacaagggtggttgcagctgagatggaagaagcattgaaagggctcccaataaggtaccaaacaacagcaacaaaatctgaacacacgggaagagagattgttgatctaatgtgccacgcaacgttcacaatgcgcttgctgtcaccagttagggttccaaattacaacttgataataatggatgaggctcatttcacagacccagccagtatagcggccagagggtacatatcaactcgtgttggaatgggagaggcagccgcaattttcatgacggcaacgccccctggaacagctgatgcctttcctcagagcaacgctccaattcaagatgaagaaagggacataccagaacgctcatggaattcaggcaatgaatggattaccgacttcgccgggaaaacggtgtggtttgtccccagcatcaaagccggaaatgacatagcaaactgcttgcgaaagaacgggaaaaaggtcattcaacttagtaggaagacttttgatacagaatatcagaagactaaactaaatgattgggactttgtggtgacaactgacatttcagaaatgggggccaatttcaaagcagatagagtgatcgacccaagaagatgtctaaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgttgctggacaacatcaacactccagaaggaatcataccagctctctttgaaccagaaagggagaagtcagccgccatagacggtgaatatcgcctgaagggtgaatccaggaagactttcgtggaactcatgaggaggggtgaccttccagtttggttagcccacaaagtagcatcagaagggatcaaatatacagatagaaaatggtgctttgatggacagcgcaacaatcaaattttagaggaaaacatggatgtggaaatctggacaaaggaaggagaaaagagaaaattaagacctaggtggcttgatgcccgcacttattcagatcccttagcactcaaggaattcaaggactttgcggctggcagaaagtcaatcgcccttgaccttgtgacagaaataggaagagtgccttcacacctagcccacagaacgagaaacgctctggacaatctggtgatgctgcacacgtcagaacatggcggtagggcctacaggcatgcggtggaggaactgccagaaacaatggaaacactcctactcttgggactcatgatcttactgacaggtggagcaatgcttttcttgatatcaggtaaagggattggaaagacttcaataggactcatttgtgtgattgcttctagcggcatgctgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcggccaatgaaatgggactgctggaaactacaaagagagatttaggaatgtctaaggagccaggtgttgtttctccaactagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactactggcattgggttgctattcacaagtgaacccactgactctgacagcggcagtacttctgctaattacacattatgctattataggtccaggactgcaggcaaaagccactcgtgaagctcaaaaaaggacagctgctggaataatgaagaatccaacggtggatgggataataacaatagacctagatccggtaatatatgattcaaaatttgaaaagcaactgggacaggtcatgctcctggttttgtgtgcagttcaactgttgttaatgagaacatcatgggccttgtgtgaagctttaactttagctacaggaccaataacaacactctgggaaggatcacctgggaagttttggaataccacgatagctgtttccatggcgaacatttttagagggagctatttagcaggagctgggcttgccttttctattatgaaatcagttggaacaggaaaaagaggaacaggctctcaaggtgaaactttaggagaaaaatggaagaagaaattgaatcaattatcccggaaagagtttgacctttacaagaagtctggaatcactgaagtggatagaacagaagccaaagaagggttgaaaagaggagaaacaacacatcatgccgtgtccagaggtagtgcaaaacttcaatggtttgtggagaggaacatggtcattcccgaaggaagagtcatagacctgggctgtggaagaggaggctggtcatattactgtgcaggactgaaaaaagtcacagaagtgcgaggatacacaaaaggcggtccaggacacgaagaaccagtgcctatgtcaacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctgaaaaacaaccagttttgcattaaagtattgaacccttacatgccagccgtgattgagcacctagaaagactacaaaggaaacacggaggaatgcttgtgagaaatccactttcacgaaactccacgcacgaaatgtactggatatctaatggtacaggtaacattgtctcttcagtcaacatggtatccagattattactgaacaggttcaagatgacacacaggagacctaccatagagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccacggatcttatgaagtcaaggccacaggctcagcctcctccatgataaatggagtcgtgaaacttctcactaaaccatgggatgtggtgcccatggtgacacagatggcaatgacagatacaactccatttggccagcagagagtctttaaagagaaagtggacaccaggacacccaggcccatgccagggacaagaaaggttatggagatcacagcggagtggctctggagaaccctggggaggaacaaaagacccaggttatgcacaagggaagagtttacaaaaaaggtcagaaccaacgcagccatgggcgccgttttcacagaggagaaccaatgggacagtgcgaaagctgctgttgaggatgaagaattttggaaactcgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcctaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcacacagcaaatggaccctgaacacaggctgttagcgaacgctatatttaagctcacataccaaaacaaagtggtcaaagttcaacgaccgactccaacgggcacggtaatggacatcatatctaggaaagaccaaagaggcagtggacaggtgggaacttatggtctgaatacatttaccaacatggaagcccagttagtcagacaaatggaaggagaaggtgtgctgtcaaaggcagacctcgagaaccctcatctgccagaaaagaaaattacacaatggttggaaaccaaaggagtggagaggttaaaaagaatggccattagcggggatgattgcgtagtgaaaccaatcgatgacaggttcgctaacgccctgcttgctctgaacgatatgggaaaggttcggaaagacatacctcaatggcagccatcaaagggatggcatgactggcagcaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtttggggaaagcctacgcccaaatgtggagtctcatgtattttcacagaagagatctcagactagcgtccaatgccatatgttcagcagtaccagtccactgggttcccacaagtagaacgacatggtctattcatgctcaccatcagtggatgaccacagaagacatgcttactgtttggaacagggtgtggatcgaggacaatccatggatggaagacaaaactccagttacaacctgggaaaatgttccatacctagggaagagagaagaccagtggtgcggatcacttattggtctcacttccagagcaacctgggcccagaacatacccacagcaattcaacaggtgagaagccttataggcaatgaagagtttctggattacatgccttcaatgaagagattcaggaaggaggaggagttggagggagccatttggtaa

SEQ ID NO: 7217 - RNA, 9873 nt, synthetic construct
  misc_feature 1..9873: note = derived and/or modified CDS sequence (wt) from DENV-3__KF041258__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagctatggacttgggagagatgtgtgatgacacggtcacttacaaatgcccccacattaccgaagtggaacctgaagacattgactgctggtgcaaccttacatcaacatgggtgacttatggaacgtgcaatcaagctggggagcatagacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagccctatttcttgcccactacataggcacctccttgacccagaaggtggttatttttatactactaatgctggtcaccccatccatgacaatgagatgtgtgggagtgggaaacagagattttgtggaaggtctgtcaggagctacgtgggttgacgtggtgctagagcacggggggtgtgtgaccaccatggctaagaacaagcccacgctggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcacacatacgtagacagaggctgggggaacggttgtggtttgtttggcaagggaagcttggtaacatgtgcgaaatttcaatgcctggaaccgatagagggaaaagtggtgcaatatgagaacctcaaatacaccgtcatcattacagtgcacacaggagaccaacaccaggtgggaaatgaaacgcagggagtcacggctgagataacgcctcaggcatcaactactgaagccatcttgcctgaatatggaacccttgggctagaatgctcaccacggacaggtttggatttcaatgaaatgatcttactaacaatgaagaacaaagcatggatggtacacagacaatggttttttgacctacctctaccatggacatcaggagctacaacagaaacaccaacttggaacaggaaggagctccttgtgacattcaaaaatgcacatgcaaaaaaacaagaagtggttgtccttggatcgcaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaacacctttgtgttgaagaaagaagtctcagaaacgcagcatgggacaatactcattaaggtcgagtacaaaggggaagatgcaccttgcaagattcctttctccacggaggatggacaagggaaagctcacaatggcagactgatcacagccaacccagtggtgactaagaaggaggagcctgttaacattgaggctgaacctccttttggggaaagcaatatagtaattggaattggagacaatgctttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtgatgaaaattggaataggtgttctcctgacttggatagggttgaattcaaaaaacacatccatgtcattttcatgtattgcgataggaatcatcacactctatctgggagctgtggtacaagctgacatggggtgtgtcataaactggaaaggcaaagaacttaaatgtggaagtggaattttcgtcaccaacgaggtccatacctggacagagcagtacaaattccaagcggactccccaaaaagattggcgacagctattgcaggcgcttgggaaaatggagtgtgcggaattaggtcaacaaccagaatggagaacctcttgtggaagcaaatagccaatgaactgaattacatattatgggaaaacaatatcaaattaacggtagttgtgggcgacacaattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccagagtgtccaagtgcctcaagagcatggaatgtgtgggaggtggaagattacgggttcggagtcttcacaaccaacatatggctgaaactccgagaggtatacacccaaatgtgtgaccataggctaatgtcggcagccgtcaaggatgagagggccgtgcatgccgacatgggctattggatagaaagccaaaagaatggaagttggaagctagaaaaagcatccctcatagaggtgaaaacctgcacatggccaaaatcacacactctttggagcaacggtgtgctagagagtgacatgatcattccaaagagtctagctggtcctatttcgcaacacaactacaggcccgggtaccacacccaaacggcaggaccctggcacttaggaaaattggagctggacttcaactattgtgaaggaacaacagttgtcatcacagaaaactgtgggacaagaggcccatcattgagaacgacaacagtgtcaggaaagttgatacacgaatggtgttgccgctcgtgcacacttcctcctctgcgatacatgggagaagacggctgttggtatggcatggagatcagacccatcagtgagaaagaagagaacatggtaaagtctttagtctcagcgggaagtggaaaggtagacaacttcacaatgggcgtcttgtgtttggcaatcctctttgaagaggtgatgagaggaaaatttgggaagaaacacatgattgcaggggttttcttcacgtttgtgctccttctctcagggcaaataacgtggagagacatggcgcacacactaataatgattgggtccaacgcctctgacaggatgggaatgggcgtcacctatctagctttaattgcaacatttaaaatccagccattcctggctttgggatttttcctaagaaaactgacatctagagaaaatttactgttaggagttggactggctatggcaacaacattacaactgccagaggacattgaacaaatggcaaatggaatcgccctggggctcatggctcttaaattgatgacacaatttgaaacatatcaattatggacggcattaatctccttaacgtgttcaaatacaattttcacgttgactgttgcctggagaacagccaccctgattttggccggagtttcacttttaccagtgtgccagtcttcgagcatgaggaaaacagactggcttccaatgacagtggcagccatgggagtcccacccctaccactctttattttcagcttgaaagacacactcaaaaggagaagctggccgctgaatgaaggggtgatggctgttgggcttgtgagcattctggccagttctctccttagaaatgacgtgcccatggctggaccattagtggccgggggcttgctgatagcatgctacgtcataactggcacgtcagcagaccttacagtagaaaaagcagcagatgtaacatgggaggaagaggctgagcaaacaggagtgtcccacaacttaatgatcacagttgatgatgatggaacaatgagaataaaagatgatgagactgagaatattctaacagtgcttttgaagacagcattactaatagtatcaggtatctttccatactccatacccgcaacattgttggtctggcatacttggcaaaagcaaacccaaagatccggtgttctatgggacgtacccagtcccccagagacacagaaagcagaactggaggaaggggtctataggatcaaacagcaaggaattcttgggaaaacccaagtaggggttggagtacaaaaagaaggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggggaggaggtgcaggttatcgccgtagagcctgggaagaacccaaagaactttcaaaccatgccaggcacatttcagactacaacaggggaaataggagcaattgcactggatttcaagcctggaacttcagggtctcctatcataaacagagagggaaaggtagtgggactatatggcaatggagtggttacaaagaatggcggctacgtcagcggaatagcgcaaacaaatgcagaaccagatggaccgacgccagagttggaagaagagatgttcaaaaaacgaaatctaaccataatggatcttcatcctgggtcaggaaagacacggaaataccttccagccattgttagagaggcaatcaagagacgtttaagaactctaattttggcaccgacaagggtggttgcagctgagatggaagaagcattgaaaggtctcccaataaggtaccaaacaacagcaacaaaatctgaacacacgggaagagagattgttgatctaatgtgccacgcaacgttcacaatgcgcttgctgtcaccagttagggttccaaattacaacttgataataatggatgaggctcatttcacagacccagccagtatagcggccagagggtacatatcaactcgtgttggaatgggagaggcagccgcaattttcatgacggcaacaccccctggaacagctgatgcctttcctcagagcaacgctccaattcaagatgaagaaagggacataccagaacgctcatggaattcaggcaatgaatggattaccgacttcgccgggaaaacggtgtggtttgtccccagcatcaaagccggaaatgacatagcaaactgcttgcgaaagaacgggaaaaaggtcattcaacttagtaggaagacttttgatacagaatatcagaagactaaactaaatgattgggactttgtggtgacaactgacatttcagaaatgggggccaatttcaaagcagatagagtgatcgacccaagaagatgtctaaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgttgctggacaacatcaacactccagaaggaatcataccagctctctttgaaccagaaagggagaagtcagccgctatagacggtgaatatcgcctgaagggtgaatccaggaagactttcgtggaactcatgaggaggggtgaccttccagtttggttagcccacaaagtagcatcagaagggatcaaatatacagatagaaaatggtgctttgatggacagcgcaacaatcaaattttagaggaaaacatggatgtggaaatctggacaaaggaaggagaaaagagaaaattaagacctaggtggcttgatgcccgcacttattcagatcccttagcactcaaggaattcaaggactttgcggctggcagaaagtcaatcgcccttgaccttgtgacagaaataggaagagtgccttcacacctagcccacagaacgagaaacgctctggacaatctggtgatgctgcacacgtcagaacatggcggtagggcctacaggcatgcggtggaggaactaccagaaacaatggaaacactcctactcttgggactcatgatcttactgacaggtggagcaatgcttttcttgatatcaggtaaaggtattggaaagacttcaataggactcatttgtgtgattgcttccagcggcatgctgtggatggccgaaatcccactccaatggatcgcgtcggctatagtcctggagttttttatgatggtgttgcttataccagaaccagaaaagcagagaaccccccaagacaaccaactcgcatatgtcgtaataggcatacttacattggctgcaataatagcggccaatgaaatgggactgctggaaactacaaagagagatttaggaatgtctaaggagccaggtgttgtttctccaactagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactactggcattgggttgctattcacaagtgaacccactgactctaacagcggcagtacttctgctaattacacattatgctattataggtccaggactgcaggcaaaagccactcgtgaagctcaaaaaaggacagctgctggaataatgaagaatccaacggtggatgggataataacaatagacctagatcctgtaatatatgattcaaaatttgaaaagcaactgggacaggtcatgctcctggttttgtgtgcagttcaattgttgttaatgagaacatcatgggccttgtgtgaagctttaactttagctacaggaccaataacaacactctgggaaggatcacctgggaagttttggaataccacgatagctgtttccatggcgaacatttttagagggagctatttagcaggagctgggcttgccttttctattatgaaatcagttggaacaggaaaaagaggaacaggctctcaaggtgaaactttaggagaaaaatggaaaaagaaattgaatcaattatcccggaaagagtttgacctttacaagaagtctggaatcactgaagtggatagaacagaagccaaagaagggttaaaaagaggagaaacaacacatcatgccgtgtccagaggtagtgcaaaacttcaatggtttgtggagagaaacatggtcattcctgaaggaagagtcatagacctgggctgtggaagaggaggctggtcatattactgtgcaggactgaaaaaagtcacagaagtgcgaggatacacaaaaggcggtccaggacacgaagaaccagtgcctatgtcaacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctgaaaaacaaccagttttgcattaaagtattgaacccttacatgccagccgtgattgagcacctagaaagactacaaaggaaacacggaggaatgcttgtgagaaatccactttcacgaaactccacgcacgaaatgtactggatatctaatggtacaggtaacatcgtctcttcagtcaacatggtatccagattattactgaacaggttcacgatgacacacaggagacctaccatagagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccacggatcttatgaagtcaaggccacaggctcagcctcctccatgataaatggagttgtgaaacttcttactaaaccatgggatgtggtgcccatggtgacacagatggcaatgacagatacaactccatttggccagcagagagtctttaaagagaaagtggacaccaggacacccaggcctatgccagggacaagaaaggttatggagatcacagcggagtggctctggagaaccctgggaaggaacaaaagacccaggttatgcacaagggaagagtttacaaaaaaggtcagaaccaacgcagccatgggcgccgtttttacagaggagaaccaatgggacagtgcgaaagctgctgtcgaggatgaagaattttggaaacttgtggacagagaacgtgaactccacaaattgggcaagtgtggaagctgcgtttacaacatgatgggcaagagagagaagaaacttggagagtttggcaaagcaaaaggcagtagagctatatggtacatgtggttgggagccaggtaccttgagttcgaagcccttggattcctaaatgaagaccactggttctcgcgtgaaaactcttacagtggagtagaaggagaaggactgcacaaactaggctacgtattaagggacatttccaagatacccggaggagccatgtatgctgatgacacagctggttgggacacaagaataacagaagatgacctgcacaatgaggaaaagatcacacagcaaatggaccctgaacacaggctgttagcgaacgctatatttaagctcacataccaaaacaaagtggtcaaagttcaacgaccgactccaacgggcacggtaatggacatcatatctaggaaagaccaaagaggcagtggacaggtgggaacttatggtctgaatacatttaccaatatggaagcccagttagtcagacaaatggaaggagaaggtgtgctgtcaaaggcagacctcgagaaccctcatctgccagaaaagaagattacacaatggttggaaaccaaaggagtggagaggttaaaaagaatggccattagcggggatgattgcgtagtgaaaccaatcgatgacaggttcgctaacgccctgcttgctctgaacgatatgggaaaggttcggaaagacatacctcaatggcagccatcaaagggatggcatgactggcagcaggttcctttctgctcccaccactttcatgaactgatcatgaaagatggaagaaagttggtggttccctgcagaccccaggacgaactaataggaagagcaagaatctctcaaggagcgggatggagccttagagaaaccgcatgtttggggaaagcctacgcccaaatgtggagtctcatgtattttcacagaagagatctcagactagcgtccaatgccatatgttcagcagtaccagtccactgggtccccacaagtagaacgacatggtctattcatgctcaccatcagtggatgaccacagaagacatgcttactgtttggaacagggtgtggatcgaggacaatccatggatggaagacaaaactccagttacaacctgggaaaatgttccatacctagggaagagagaagaccaatggtgcggatcacttattggtctcacctccagagcaacctgggcccagaacatacccacagcaattcaacaggtgagaagccttataggcaatgaagagtttctggattacatgccttcaatgaagagattcaggaaggaggaagagttggagggagccatttggtaa

SEQ ID NO: 7218 - RNA, 9873 nt, synthetic construct
  misc_feature 1..9873: note = derived and/or modified CDS sequence (wt) from DENV-3__KF041257__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagctatggacttgggagagatgtgtgatgacacggtcacttacaaatgcccccacattaccgaagtggaacctgaagacattgactgctggtgcaaccttacatcaacatgggtaacttatggaacgtgcaatcaagctggagagcatagacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagccctatttcttgcccactacataggcacctccttgacccagaaggtggttatttttatactactaatgctggtcaccccatccatgacaatgagatgtgtgggagtgggaaacagagattttgtggaaggtctgtcaggagctacgtgggttgacgtggtgctagagcacggggggtgtgtgaccaccatggctaagaacaagcccacgctggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggttgtggtttgtttggcaagggaagcttggtaacatgtgcgaaatttcaatgcctggaaccgatagagggaaaagtggtgcaatatgagaacctcaaatacaccgtcatcattacagtgcacacaggagaccaacaccaggtgggaaatgaaacgcagggagtcacggctgagataacgcctcaggcatcaactactgaagccatcttgcctgaatatggaacccttgggctagaatgctcaccacggacaggtttggatttcaatgaaatgatcttactaacaatgaagaacaaagcatggatggtacacagacaatggttttttgacctacctctaccatggacatcaggagctacaacagaaacaccaacttggaacaggaaggagctccttgtgacattcaaaaatgcacatgcgaaaaaacaagaagtggttgtccttggatcgcaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacggaggatggacaagggaaagctcacaatggcagactgatcacagccaacccagtggtgactaagaaggaggagcctgttaacattgaggctgaacctccttttggggaaagcaatatagtaattggaattggagacaatgctttgaaaatcaactggtacaagaagggaagctctattggaaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtgatgaaaattggaataggtgttctcttgacttggatagggttgaattcaaaaaacacatccatgtcattttcatgtattgcgataggaatcatcacactctatctgggagctgtggtacaagctgacatggggtgtgtcataaactggaaaggcaaagaacttaaatgtggaagtggaattttcgtcaccaacgaggtccatacctggacagagcagtacaaattccaagcggattccccaaaaagattggcgacagctattgcaggcgcttgggaaaatggagtgtgcggaattaggtcaacaaccagaatggagaatctcttgtggaagcaaatagccaatgaactgaactacatattatgggaaaacaatatcaaattaacggtagttgtgggcgacacaattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccagagtgtccaagtgcctcaagagcatggaatgtgtgggaggtggaagattacgggttcggagtcttcacaaccaacatatggctgaaactccgagaggtgtacacccaaatgtgtgaccataggctaatgtcggcagccgtcaaggatgagagggccgtgcatgccgacatgggctattggatagaaagccaaaagaatggaagttggaagctagaaaaagcatccctcatagaggtgaaaacctgcacatggccaaaatcacacactctttggagcaacggtgtgctagagagtgacatgatcattccaaagagtctagctggtcctatttcgcaacacaactacaggcccgggtaccacacccaaacggcaggaccctggcacttaggaaaattggagctggacttcaactattgtgaaggaacaacagttgtcatcacagaaaactgtgggacaagaggcccatcattgagaacgacaacagtgtcaggaaagttgatacacgaatggtgttgccgctcgtgcacacttcctcctctgcgatacatgggagaagacggctgttggtatggcatggagatcagacccatcagtgagaaagaagagaacatggtaaagtctttagtctcagcgggaagtggaaaggtagacaacttcacaatgggcgtcttgtgtttggcaatcctctttgaagaggtgatgagaggaaaatttgggaagaaacacatgattgcaggggttttcttcacgtttgtgctccttctctcagggcaaataacgtggagagacatggcgcacacactaataatgattgggtccaacgcctctgacaggatgggaatgggcgtcacctatctagctttaattgcaacatttaaaatccagccattcctggctttgggatttttcctaagaaaactgacatctagagaaaatttactgttaggagttggactggctatggcaacaacattacaactgccagaggacattgaacaaatggcaaatggaatcgccctggggctcatggctcttaaattgataacacaatttgaaacatatcaattatggacggcattaatctccttaacgtgttcaaatacaattttcacgttgactgttgcctggagaacagccaccctgattttggccggagtttcacttttaccagtgtgccagtcttcgagcatgaggaaaacagactggcttccaatgacagtggcagccatgggagtcccacccctaccactctttatttttagcttgaaagacacactcaaaaggagaagctggccgctgaatgaaggggtgatggctgttgggcttgtgagcattctggccagttctctccttagaaatgacgtgcccatggctggaccattagtggccgggggcttgctgatagcatgctacgtcataactggcacgtcagcagaccttacagtagaaaaagcagcagatgtaacatgggaggaagaggctgagcaaacaggagtgtcccacaacttaatgatcacagttgatgatgatggaacaatgagaataaaagatgatgagactgagaatattctaacagtgcttttgaagacagcattactaatagtatcaggtatctttccatactccatacccgcaacattgttggtctggcatacttggcaaaagcaaacccaaagatccggtgttctatgggacgtacccagtcccccagagacacagaaagcagaactggaggaaggggtctataggatcaaacagcaaggaattcttgggaaaacccaagtaggggttggagtacaaaaagaaggagtcttccacaccatgtggcacgtcacaagaggggcagtgttgacacataatgggaaaagactggaaccaaactgggctagcgtaaaaaaagatctgatttcatacggaggaggatggagattgagcgcacaatggcaaaagggggaggaggtgcaggttatcgccgtagagcctgggaagaacccaaagaactttcaaaccatgccaggcacatttcagactacaacaggggaaataggagcaattgcactggatttcaagcctggaacttcagggtctcctatcataaacagagagggaaaggtagtgggactatatggcaatggagtggttacaaagaatggcggctacgtcagcggaatagcgcaaacaaatgcagaaccagatggaccgacgccagagttggaagaagagatgttcaaaaaacgaaatctaaccataatggatcttcatcctgggtcaggaaagacacggaaataccttccagccattgttagagaggcaatcaagagacgtttaagaactctaattttggcaccgacaagggtggttgcagctgagatggaagaagcattgaaagggctcccaataaggtaccaaacaacagcaacaaaatctgaacacacgggaagagagattgttgatctaatgtgccacgcaacgttcacaatgcgcttgctgtcaccagttagggttccaaattacaacttgataataatggatgaggctcatttcacagacccagccagtatagcggccagagggtacatatcaactcgtgttggaatgggagaggcagccgcaattttcatgacggcaacgccccctggaacagctgatgcctttcctcagagcaacgctccaattcaagatgaagaaagggacataccagaacgctcatggaattcaggcaatgaatggattaccgacttcgccgggaaaacggtgtggtttgtccccagcatcaaagccggaaatgacatagcaaactgcttgcgaaagaacgggaaaaaggtcattcaacttagtaggaagacttttgatacagaatatcagaagactaaactaaatgattgggactttgtggtgacaactgacatttcagaaatgggggccaatttcaaagcagatagagtgatcgacccaagaagatgtctaaaaccagtgatcctgacagatggaccagagcgggtgatcctggctggaccaatgccagtcaccgcggcgagtgccgcgcaaaggagagggagagttggcaggaacccacaaaaagaaaatgaccagtacatattcacgggccagcctctcaacaatgatgaagaccatgctcactggacagaagcaaaaatgttgctggacaacatcaacactccagaaggaatcataccagctctctttgaaccagaaagggagaagtcagccgccatagacggtgaatatcgcctgaagggtgaatccaggaagactttcgtggaactcatgaggaggggtgaccttccagtttggttagcccacaaagtagcatcagaagggatcaaatatacagatagaaaatggtgctttgatggacagcgcaacaatcaaattttagaggaaaacatggatgtggaaatctggacaaaggaaggagaaaagagaaaattaagacctaggtggcttgatgcccgcacttattcagatcccttagcactcaaggaattcaaggactttgcggctggcagaaagtcaatcgcccttgaccttgtgacagaaataggaagagtgccttcacacctagcccacagaacgagaaacgctctggacaatctggtgatgctgcacacgtcagaacatggcggtagggcctacaggcatgcggtggaggaactaccagaaacaatggaaacactcctactcttgggactcatgatcttactgacaggtggagcaatgctcttcttgatatcaggtaaaggtattggaaagacttcaataggactcatttgtgtgattgcttccagcggcatgctgtggatggccgaaatcccactccaatggatcgcgtcggctatagtcctggagttttttatgatggtgttgcttataccagaaccagaaaagcagagaaccccccaagacaaccaactcgcatatgtcgtaataggcatacttacattggctgcaataatagcggccaatgaaatgggactgctggaaactacaaagagagatttaggaatgtctaaggagccaggtgttgtttctccaactagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactactggcattgggttgctattcacaagtgaacccactgactctaacagcggcagtacttctgctaattacacattatgctattataggtccaggactgcaggcaaaagccactcgtgaagctcaaaaaaggacagctgctggaataatgaagaatccaacggtggatgggataataacaatagacctagatcctgtaatatatgattcaaaatttgaaaagcaactgggacaggtcatgctcctggttttgtgtgcagtccaactgttgttaatgagaacatcatgggccttgtgtgaagctttaactttagctacaggaccaataacaacactctgggaaggatcacctgggaagttttggaataccacgatagctgtttccatggcgaacatttttagagggagctatttagcaggagctgggcttgccttttctattatgaaatcagttggaacaggaaaaagaggaacaggctctcaaggtgaaactttacgagaaaaatggaaaaagaaattgaatcaattatcccggaaagagtttgacctttacaagaagtctggaatcactgaagtggatagaacagaagccaaagaagggttaaaaagaggagaaacaacacatcatgccgtgtccagaggtagtgcaaaacttcaatggtttgtggagagaaacatggtcattcctgaaggaagagtcatagacctgggctgtggaagaggaggctggtcatattactgtgcaggactgaaaaaagtcacagaagtgcgaggatacacaaaaggcggtccaggacacgaagaaccagtgcctatgtcaacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctgaaaaacaaccagttttgcattaaagtattgaacccttacatgccagccgtgattgagcacctagaaagactacaaaggaaacacggaggaatgcttgtgagaaatccactttcacgaaactccacgcacgaaatgtactggatatctaatggtacaggtaacatcgtctcttcagtcaacatggtatccagattattactgaacaggttcacgatgacacacaggagacctaccatagagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccacggatcttatgaagtcaaggccacaggctcagcctcctccatgataaatggagtcgtgaaacttctcactaaaccatgggatgtggtgcccatggtgacacagatggcgatgacagatacaactccatttggccagcagagagtctttaaagagaaagtggacaccaggacacccaggcctatgccagggacaagaaaggttatggagatcacagcggagtggctctggagaaccctgggaaggaacaaaagacccaggttatgcacaagggaagagtttacaaaaaaggtcagaaccaacgcagccatgggcgccgtttttacagaggagaaccaatgggacagtgcgaaagctgctgttgaggatgaagaattttggaaacttgtggacagagaacgtgaactccacaaattgggcaagtgtggaagctgcgtttacaacatgatgggcaagagagagaagaaacttggagagtttggcaaagcaaaaggcagtagagctatatggtacatgtggttgggagccaggtaccttgagttcgaagcccttggattcctaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcacacagcaaatggaccctgaacacaggctgttagcgaacgctatatttaagctcacataccaaaacaaagtggtcaaagttcaacgaccgactccaacgggcacggtaatggacatcatatctaggaaagaccaaagaggcagtggacaggtgggaacttatggtctgaatacatttaccaatatggaagcccagttagtcagacaaatggaaggagaaggtgtgctgtcaaaggcagacctcgagaaccctcatctgccagaaaagaaaattacacaatggttggaaaccaaaggagtggagaggttaaaaagaatggccattagcggggatgattgcgtagtgaaaccaatcgatgacaggttcgctaacgccctgcttgctctgaacgatatgggaaaggttcggaaagacatacctcaatggcagccatcaaagggatggcatgactggcagcaggttcctttttgctcccaccactttcatgaattgatcatgaaagatggaagaaagttggtggttccctgcagaccccaggacgaactaataggaagagcaagaatctctcaaggagcgggatggagccttagagaaaccgcatgtttggggaaagcctacgcccaaatgtggagtctcatgtattttcacagaagagatctcagactagcgtccaatgccatatgttcagcagtaccagtccactgggtccccacaagtagaacgacatggtctattcatgctcaccatcagtggatgaccacagaagacatgcttactgtttggaacagggtgtggatcgaggacaatccatggatggaagacaaaactccagttacaacctgggaaaatgttccatacctagggaagagagaagaccaatggtgcggatcacttattggtctcacctccagagcaacctgggcccagaacatacccacagcaattcaacaggtgagaagccttataggcaatgaagagtttctggattacatgccttcaatgaagagattcaggaaggaggaggagttggagggagccatttggtaa

SEQ ID NO: 7219 - RNA, 9873 nt, synthetic construct
  misc_feature 1..9873: note = derived and/or modified CDS sequence (wt) from DENV-3__KF041255__SS-prME
  source 1..9873: mol_type = other RNA
acatcgctctgtctcatgatgatattgccagcagcacttgctttccacttgacttcacgaaatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagccctatttcttgcccattacataggcacctccttgacccagaaggtggttatttttatactactaatgctggtcaccccatccatgacaatgagatgtgtgggagtgggaaacagagattttgtggaaggtctgtcaggagctacgtgggttgacgtggtgctagagcacggggggtgtgtgaccaccatggctaagaacaagcccacgctggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcacacatacgtagacagaggctgggggaacggttgtggtttgtttggcaagggaagcttggtaacatgtgcgaaatttcaatgcctggaaccgatagagggaaaagtggtgcaatatgagaacctcaaatacaccgtcatcattacagtgcacacaggagaccaacaccaggtgggaaatgaaacgcagggagtcacggctgagataacgcctcaggcatcaactactgaagccatcttgcctgaatatggaacccttgggctagaatgctcaccacggacaggtttggatttcaatgaaatgatcttactaacaatgaagaacaaagcatggatggtacacagacaatggttttttgacctacctctaccatggacatcaggagctacaacagaaacaccaacttggaacaggaaggagctccttgtgacattcaaaaatgcacatgcgaaaaaacaagaagtggttgtccttggatcgcaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgatcacagccaacccagtggtgactaagaaggaggagcctgttaacattgaggctgaacctccttttggggaaagtaatatagtaattggaattggagacaatgctttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtgatgaaaattggaataggtgttctcttgacttggatagggttgaattcaaaaaacacatccatgtcattttcatgcattgcgataggaatcatcacactctatctgggagctgtggtacaagctgacatggggtgtgtcataaactggaaaggcaaagaacttaaatgtggaagtggaattttcgtcaccaacgaggtccatacctggacagagcagtacaaattccaagcggattccccaaaaagattggcgacagctattgcaggcgcttgggaaaatggagtgtgcggaattaggtcaacaaccagaatggagaatctcttgtggaagcaaatagccaatgaactcaactacatattatgggaaaacaatatcaaattaacggtagttgtgggcgacacaataggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccagagtgtccaagtgcctcaagagcatggaatgtgtgggaggtggaagattacgggttcggagtcttcacaaccaacatatggctgaaactccgagaggtgtacacccaaatgtgtgaccataggctaatgtcggcagccgtcaaggatgagagggccgtgcatgccgacatgggctattggatagaaagccaaaagaatggaagttggaagctagaaaaagcatccctcatagaggtgaaaacctgcacatggccaaaatcacatactctttggagcaacggtgtgctagagagtgacatgatcattccaaagagtctagctggtcctatttcgcaacacaactacaggcccgggtaccacacccaaacggcaggaccctggcacttaggaaaattggagctggacttcaactattgtgaaggaacaacagttgtcatcacagaaaactgtgggacaagaggcccatcattgagaacgacaacagtgtcaggaaagttgatacacgaatggtgttgccgctcgtgcacacttcctcctctgcgatacatgggagaagacggctgttggtatggcatggagatcagacccatcagtgagaaagaagagaacatggtaaagtctttagtctcagcgggaagtggaaaggtagacaacttcacaatgggtgtcttgtgtttggcaatcctctttgaagaggtgatgagaggaaaatttgggaagaaacacatgattgcaggggttttcttcacgtttgtgctccttctctcagggcaaataacatggagagacatggcgcacacactaataatgattgggtccaacgcctctgacaggatgggaatgggcgtcacctatctagctttaattgcaacatttaaaatccagccattcctggctttgggatttttcctaagaaaactgacatctagagaaaatttactgttaggagttggactggctatggcaacaacattacaactgccagaggacattgaacaaatggcaaatggaatcgccctggggctcatggctcttaaactgataacacaatttgaaacatatcaattatggacggcattaatctccttaacgtgttcaaatacaattttcacgttgactgttgcctggagaacagccaccctgattttggccggagtttcacttttaccagtgtgccagtcttcgagcatgaggaaaacagactggcttccaatgacagtggcagccatgggagtcccacccctaccactctttatttttagcttgaaagacacactcaaaaggagaagctggccgctgaatgaaggggtgatggctgttgggcttgtgagcattctggccagttctctccttagaaatgacgtgcccatggctggaccattagtggccgggggcttgctgatagcatgctacgtcataactggcacgtcagcagaccttacagtagaaaaagcagcagatgtaacatgggaggaagaggctgagcaaacaggagtgtcccacaacttaatgatcacagttgatgatgatggaacaatgagaataaaagatgatgagactgagaatattctaacagtgcttttgaagacagcattactaatagtatcaggtatctttccatactccatacccgcaacattgttggtctggcatacttggcaaaagcaaacccaaagatccggtgttctatgggacgtacccagtcccccagagacacagaaagcagaactggaggaaggggtctataggattaaacagcaaggaattcttgggaaaacccaagtaggggttggagtacaaaaagaaggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacatttcagactacaacaggggaaataggagcaattgcactggatttcaagcctggaacttcagggtctcctatcataaacagagagggaaaggtagtgggactatatggcaatggagtggttacaaagaatggcggctacgtcagcggaatagcgcaaacaaatgcagaaccagatggaccgacgccagagttggaagaagagatgttcaaaaaacgaaatctaaccataatggatcttcatcctgggtcaggaaagacacggaaataccttccagccattgttagagaggcaatcaagagacgtttaagaactctaattttggcaccgacaagggtggttgcagctgagatggaagaagcattgaaagggctcccaataaggtaccaaacaacagcaacaaaatctgaacacacgggaagagagattgttgatctaatgtgccacgcaacgttcacaatgcgcttgctgtcaccagttagggttccaaattacaacttgataataatggatgaggctcatttcacagacccagccagtatagcggccagagggtacatatcaactcgtgttggaatgggagaggcagccgcaattttcatgacggcaacgccccctggaacagctgatgcctttcctcagagcaacgctccaattcaagatgaagaaagggacataccagaacgctcatggaattcaggcaatgaatggattaccgacttcgccgggaaaacggtgtggtttgtccccagcatcaaagccggaaatgacatagcaaactgcttgcgaaagaacgggaaaaaggtcattcaacttagtaggaagacttttgatacagaatatcagaagactaaactaaatgattgggactttgtggtgacaactgacatttcagaaatgggggccaatttcaaagcagatagagtgattgacccaagaagatgtctaaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgttgctggacaacatcaacactccagaaggaatcataccagctctctttgaaccagaaagggagaagtcagccgccatagacggtgaatatcgcctgaagggtgaatccaggaagactttcgtggaactcatgaggaggggtgaccttccagtttggttagcccacaaagtagcatcagaagggatcaaatatacagatagaaaatggtgctttgatggacagcgcaacaatcaaattttagaggaaaacatggatgtggaaatctggacaaaggaaggagaaaagagaaaattaagacctaggtggcttgatgcccgcacttattcagatcccttagcactcaaggaattcaaggactttgcggctggcagaaagtcaatcgcccttgaccttgtgacagaaataggaagagtgccttcacacctagcccacagaacgagaaacgctctggacaatctggtgatgctgcacacgtcagaacatggcggtagggcctacaggcatgcggtggaggaactaccagaaacaatggaaacactcctactcttgggactcatgatcttactgacaggtggagcaatgcttttcttgatatcaggtaaagggattggaaagacttcaataggactcatttgtgtgattgcttccagcggcatgctgtggatggccgaaatcccactccaatggatcgcgtcggctatagtcctggagttttttatgatggtgttgcttataccagaaccagaaaagcagagaaccccccaagacaaccaactcgcatatgtcgtaataggcatacttacattggctgcaataatagcggccaatgaaatgggactgctggaaactacaaagagagatttaggaatgtctaaggagccaggtgttgtttctccaactagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactactggcattgggttgctattcacaagtgaacccactgactctaacagcggcagtacttctgctaattacacattatgctattataggtccaggactgcaggcaaaagccactcgtgaagctcaaaaaaggacagctgctggaataatgaagaatccaacggtggatgggataataacaatagacctagatcctgtaatatatgattcaaaatttgaaaagcaactgggacaggtcatgctcctggttttgtgtgcagttcaactgttgttaatgagaacatcatgggccttgtgtgaagctttaactttagctacaggaccaataacaacactctgggaaggatcacctgggaagttttggaataccacgatagctgtttccatggcgaacatttttagagggagctatttagcaggagctgggcttgccttttctattatgaaatcagttggaacaggaaaaagaggaacaggctctcaaggtgaaactttaggagaaaaatggaaaaagaaattgaatcaattatcccggaaagagtttgacctttacaagaagtctggaatcactgaagtggatagaacagaagccaaagaagggttgaaaagaggagaaacaacacatcatgccgtgtccagaggtagtgcaaaacttcaatggtttgtggagagaaacatggtcattcccgaaggaagagtcatagacctgggctgtggaagaggaggctggtcatattactgtgcaggactgaaaaaagtcacagaagtgcgaggatacacaaaaggcggtccaggacacgaagaaccagtgcctatgtcaacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctgaaaaacaaccagttttgcattaaagtattgaacccttacatgccagccgtgattgagcacctagaaagactacaaaggaaacacggaggaatgcttgtgagaaatccactttcacgaaactccacgcacgaaatgtactggatatctaatggtacaggtaacattgtctcttcagtcaacatggtatccagattattactgaacaggttcaagatgacacacaggagacctaccatagagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccacggatcttatgaagtcaaggccacaggctcagcctcctccatgataaatggagtcgtgaaacttctcactaaaccatgggatgtggtgcccatggtgacacagatggcaatgacagatacaactccatttggccagcagagagtctttaaagagaaagtggacaccaggacacccaggcctatgccagggacaagaaaggttatggagatcacagcggagtggctctggagaaccctgggaaggaacaaaagacccaggttgtgcacaagggaagagtttacaaaaaaggtcagaaccaacgcagccatgggcgccgttttcacagaggagaaccaatgggacagtgcgaaagctgctgttgaggatgaagaattttggaaactcgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcctaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcacacagcaaatggaccctgaacacaggctgttagcgaacgctatatttaagctcacataccaaaacaaagtggtcaaagttcaacgaccgactccaacgggcacggtaatggacatcatatctaggaaagaccaaagaggcagtggacaggtgggaacttatggtctgaatacatttaccaacatggaagcccagttagtcagacaaatggaaggagaaggtgtgctgtcaaaggcagacctcgagaaccctcatctgccagaaaagaaaattacacaatggttggaaaccaaaggagtggagaggttaaaaagaatggccattagcggggatgattgcgtagtgaaaccaatcgatgacaggttcgctaacgccctgcttgctctgaacgatatgggaaaggttcggaaagacatacctcaatggcagccatcaaagggatggcatgactggcagcaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtttggggaaagcctacgcccaaatgtggagtctcatgtattttcacagaagagatctcagactagcgtccaatgccatatgttcagcagtaccagtccactgggtccccacaagtagaacgacatggtctattcatgctcaccatcagtggatgaccacagaagacatgcttactgtttggaacagggtgtggatcgaggacaatccatggatggaagacaaaactccagttacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggattacatgccttcaatgaagagattcaggaaggaggaggagttggagggagccatttggtaa

SEQ ID NO: 7220 - RNA, 9873 nt, synthetic construct
  misc_feature 1..9873: note = derived and/or modified CDS sequence (wt) from DENV-3__KF041256__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagccctatttcttgcccattacataggcacctccttgacccagaaggtggttatttttatactactaatgctggtcaccccatccatgacaatgagatgtgtgggagtgggaaacagagattttgtggaaggtctgtcaggagctacgtgggttgacgtggtgctagagcacggggggtgtgtgaccaccatggctaagaacaagcccacgctggatatagagcttcagaagactgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggttgtggtttgtttggcaagggaagcttggtaacatgtgcgaaatttcaatgcctggaaccgatagagggaaaagtggtgcaatatgagaacctcaaatacaccgtcatcattacagtgcacacaggagaccaacaccaggtgggaaatgaaacgcagggagtcacggctgagataacgcctcaggcatcaactactgaagccatcttgcctgaatatggaacccttgggctagaatgctcaccacggacaggtttggatttcaatgaaatgatcctactaacaatgaagaacaaagcatggatggtacacagacaatggttttttgacctacctctaccatggacatcaggagctacaacagaaacaccaacttggaacaggaaggagctccttgtgacattcaaaaatgcacatgcgaaaaaacaagaagtggttgtccttggatcgcaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaatacctttgtgttgaagaaagaagtctcagaaacgcagcatgggacaatacttattaaggtcgagtacaaaggggaagatgcaccttgcaagattcctttctccacagaggatggacaagggaaagctcacaatggcagactgatcacagccaacccagtggtgactaagaaggaggagcctgttaacattgaggctgaacctccttttggggaaagcaatatagtaattggaattggagacaatgctttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtgatgaaaattggaataggtgttctcttgacttggatagggttgaattcaaaaaacacatccatgtcattttcatgcattgcgataggaatcatcacactctatctgggagctgtggtacaagctgacatggggtgtgtcataaactggaaaggcaaagaactaaaatgtggaagtggaattttcgtcaccaacgaggtccatacctggacagagcagtacaaattccaagcggattccccaaaaagattggcgacagctattgcaggcgcttgggaaaatggagtgtgcggaattaggtcaacaaccagaatggagaatctcttgtggaagcaaatagccaatgaactcaactacatattatgggaaaacaatatcaaattaacggtagttgtgggcgacacaattggggtcttagagcaagggaaaagaacactaacaccacaacccatggagctaaaatactcatggaaaacgtggggaaaggcaaaaatagtgacagctgaaacacaaaattcctctttcataatagacgggccaaatacaccagagtgtccaagtgcctcaagagcatggaatgtgtgggaggtggaagattacgggttcggagtcttcacaaccaacatatggctgaaactccgagaggtgtacacccaaatgtgtgaccataggctaatgtcggcagccgtcaaggatgagagggccgtgcatgccgacatgggctattggatagaaagccaaaagaatggaagttggaagctagaaaaagcatccctcatagaggtgaaaacctgcacatggccaaaatcacacactctttggagcaacggtgtgctagagagtgacatgatcattccaaagagtctagctggtcctatttcgcaacacaactacaggcccgggtaccacacccaaacggcaggaccctggcacttaggaaaattggaactggacttcaactattgtgaaggaacaacagttgtcatcacagaaaactgtgggacaagaggcccatcattgagaacgacaacagtgtcaggaaagttgatacacgaatggtgttgccgctcgtgcacacttcctcctctgcgatacatgggagaagacggctgttggtatggcatggagatcagacccatcagtgagaaagaagagaacatggtaaagtctttagtctcagcgggaagtggaaaggtagacaacttcacaatgggtgtcttgtgtttggcaatcctctttgaagaggtgatgagaggaaaatttgggaagaaacacatgattgcaggggttttcttcacgtttgtgctccttctctcagggcaaataacatggagagacatggcgcacacactaataatgattgggtccaacgcctctgacaggatgggaatgggcgtcacctatctagctttaattgcaacatttaaaatccagccattcctggctttgggatttttcctaagaaaactgacatctagagaaaatttactgttaggagttggactggctatggcaacaacattacaactgccagaggacattgaacaaatggcaaatggaatcgccctggggctcatggctcttaaattgataacacaatttgaaacatatcaattatggacggcattaatctccttaacgtgttcaaatacaattttcacgttgactgttgcctggagaacagccaccctgattttggccggagtttcactcttaccagtgtgccagtcttcgagcatgaggaaaacagactggcttccaatgacagtggcagccatgggagtcccacccctaccactctttatttttagcttgaaagacacactcaaaaggagaagctggccgctgaatgaaggggtgatggctgttgggcttgtgagcattctggccagttctctccttagaaatgacgtgcccatggctggaccattagtggccgggggcttgctgatagcatgctacgtcataactggcacgtcagcagaccttacagtagaaaaagcagcagatgtaacatgggaggaagaggctgagcaaacaggagtgtcccacaacttaatgatcacagttgatgatgatggaacaatgagaataaaagatgatgagactgagaatattctaacagtgcttttgaagacagcattactaatagtatcaggtatctttccatactccatacccgcaacattgttggtctggcatacttggcaaaagcaaacccaaagatccggtgttctatgggacgtacccagtcccccagagacacagaaagcagaactggaggaaggggtctataggatcaaacagcaaggaattcttgggaaaacccaagtaggggttggagtacaaaaagaaggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacatttcagactacaacaggggaaataggagcaattgcactggatttcaagcctggaacttcagggtctcctatcataaacagagagggaaaggtagtgggactatatggcaatggagtggttacaaagaatggcggctacgtcagcggaatagcgcaaacaaatgcagaaccagatggaccgacgccagagttggaagaagaaatgttcaaaaaacgaaatctaaccataatggatcttcatcctgggtcaggaaagacacggaaataccttccagccattgttagagaggcaatcaagagacgtttaagaactctaattttggcaccgacaagggtggttgcagctgagatggaagaagcattgaaagggctcccaataaggtaccaaacaacagcaacaaaatctgaacacacgggaagagagattgttgatctaatgtgccacgcaacgctcacaatgcgcttgctgtcaccagttagggttccaaattacaacttgataataatggatgaggctcatttcacagacccagccagtatagcggccagagggtacatatcaactcgtgttggaatgggagaggcagccgcaattttcatgacggcaacgccccctggaacagctgatgcctttcctcagagcaacgctccaattcaagatgaagaaagggacataccagaacgctcatggaattcaggcaatgaatggattaccgacttcgccgggaaaacggtgtggtttgtccccagcatcaaagccggaaatgacatagcaaactgcttgcgaaagaacgggaaaaaggtcattcaacttagtaggaagacttttgatacagaatatcagaagactaaactaaatgattgggactttgtggtgacaactgacatttcagaaatgggggccaatttcaaagcagatagagtgatcgacccaagaagatgtctaaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgttgctggacaacatcaacactccagaaggaatcataccagctctctttgaaccagaaagggagaagtcagccgccatagacggtgaatatcgcctgaagggtgaatccaggaagactttcgtggaactcatgaggaggggtgaccttccagtttggttagcccacaaagtagcatcagaagggatcaaatatacagatagaaaatggtgctttgatggacagcgcaacaaccaaattttagaggaaaacatggatgtggaaatctggacaaaggaaggagaaaagagaaaattaagacctaggtggcttgatgcccgcacttattcagatcccttagcactcaaggaattcaaggactttgcggctggcagaaagtcaatcgcccttgaccttgtgacagaaataggaagagtgccttcacacctagcccacagaacgagaaacgctctggacaatctggtgatgctgcacacgtcagaacatggcggtagggcctacaggcatgcggtggaggaactaccagaaacaatggaaacactcctactcttgggactcatgatcttactgacaggtggagcaatgcttttcttgatatcaggtaaagggattggaaagacttcaataggactcatttgtgtgattgcttccagcggcatgctgtggatggccgaaatcccactccaatggatcgcgtcggctatagtcctggagttttttatgatggtgttgcttataccagaaccagaaaagcagagaaccccccaagacaaccaactcgcatatgtcgtaataggcatacttacattggctgcaataatagcggccaatgaaatgggactgctggaaactacaaagagagatttaggaatgtctaaggagccaggtgttgtttctccaactagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactactggcattgggttgctattcacaagtgaacccactgactctaacagcggcagtacttctgctaattacacattatgctattataggtccaggactgcaggcaaaagccactcgtgaagctcaaaaaaggacagctgctggaataatgaagaatccaacggtggatgggataataacaatagacctagatcctgtaatatatgattcaaaatttgaaaagcaactgggacaggtcatgctcctggttttgtgtgcagttcaactgttgttaatgagaacatcatgggccttgtgtgaagctttaactttagctacaggaccaataacaacactctgggaaggatcacctgggaagttttggaataccacgatagctgtttccatggcgaacatttttagagggagctatttagcaggagctgggcttgccttttctattatgaaatcagttggaacaggaaaaagaggaacaggctctcaaggtgaaactttaggagaaaaatggaaaaagaaattgaatcaattatcccggaaagagtttgacctttacaagaagtctggaatcactgaagtggatagaacagaagccaaagaagggttgaaaagaggagaaacaacacatcatgccgtgtccagaggtagtgcaaaacttcaatggtttgtggagagaaacatggtcattcccgaaggaagagtcatagacctgggctgtggaagaggaggctggtcatattactgtgcaggactgaaaaaagtcacagaagtgcgaggatacacaaaaggcggtccaggacacgaaaaaccagtgcctatgtcaacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctgaaaaacaaccagttttgcattaaagtattgaacccttacatgccagctgtgattgagcacctagaaagactacaaaggaaacacggaggaatgcttgtgagaaatccactttcacgaaactccacgcacgaaatgtactggatatctaatggtacaggtaacattgtctcttcagtcaacatggtatccagattattactgaacaggttcaagatgacacacaggagacctaccatagagaaagatgtggatttaggagcaggaactcgacatgttaatgcggaaccagaaacacccaacatggatgtcatcggggaaagaataaaaaggatcaaggaggagcataattcaacatggcactatgatgacgaaaacccctacaaaacgtgggcttaccacggatcttatgaagtcaaggccacaggctcagcctcctccatgataaatggagtcgtgaaacttctcactaaaccatgggatgtggtgcccatggtgacacagatggcaatgacagatacaactccatttggccagcagagagtctttaaagagaaagtggacaccaggacacccaggcctatgccagggacaagaaaggttatggagatcacagcggagtggctctggagaaccctgggaaggaacaaaagacccaggttatgcacaagggaagagtttacaaaaaaggtcagaaccaacgcagccatgggcgccgttttcacagaggagaaccaatgggacagtgcgaaagctgctgttgaggatgaagaattttggaaactcgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcctaaatgaagaccactggttctcgcgtgaaaactcttacagtggagtggaaggagaaggactgcacaagctaggctacatattaagggacatttccaagatacccggaggagccatgtatgctgatgacacagctggttgggacacaagaataacagaagatgacctgcacaatgaggaaaagatcacacagcaaatggaccctgaacacaggctgttagcgaacgctatatttaagctcacataccaaaacaaagtggtcaaagttcaacgaccgactccaacgggcacggtaatggacatcatatctaggaaagaccaaaggggcagtggacaggtgggaacttatggtctgaatacattcaccaacatggaagcccagctagtcagacaaatggaaggagaaggtgtgctgtcaaaggcagacctcgagaaccctcatctgccagaaaagaaaattacacaatggttggaaaccaaaggagtggagaggttaaaaagaatggccattagcggggatgattgcgtagtgaaaccaatcgatgacaggttcgctaacgccctgcttgctctgaacgatatgggaaaggttcggaaagacatacctcaatggcagccatcaaagggatggcatgactggcagcaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtttggggaaagcctacgcccaaatgtggagtctcatgtattttcacagaagagatctcagactagcgtccaatgccatatgttcagcagtaccaatccactgggtccccacaagtagaacgacatggtctattcatgctcaccatcagtggatgaccacagaagacatgcttactgtttggaacagggtgtggatcgaggacaatccatggatggaagacaaaactccagttacaacctgggaaaatgtcccatacctagggaagagagaagaccaatggtgcggatcacttattggtctcacttccagagcaacctgggcccagaacatacccacagcaattcaacaggtgagaagccttataggcaatgaagagtttctggattacatgccttcaatgaagagattcaggaaggaggaggagttggagggagccatttggtaa

SEQ ID NO: 7221 - RNA, 9873 nt, synthetic construct
  misc_feature 1..9873: note = derived and/or modified CDS sequence (wt) from DENV-3__KF041254__SS-prME
  source 1..9873: mol_type = other RNA
acatcgctctgtctcatgatgatattaccagcagcacttgctttccacttgacttcacgagatggagagccgcgcatgattgtggggaagaatgaaagaggaaaatccctactttttaagacagcctctggaatcaacatgtgcacactcatagctatggacttgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtggcgttagctccccatgtcggcatgggactggacacacgcacccaaacttggatgtcggctgaaggagcttggagacaagtcgagaaggtagagacatgggcccttaggcacccagggttcaccatactagccctatttcttgcccactacataggcacctccttgacccagaaggtggttatttttatactactaatgctggtcaccccatccatgacaatgagatgtgtgggagtgggaaacagagattttgtggaaggtctgtcaggagctacgtgggttgacgtggtgctagagcacggggggtgtgtgaccaccatggctaagaacaagcccacgctggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcacacatacgtagacagaggctgggggaacggttgtggtttgtttggcaagggaagcttggtaacatgtgcgaaatttcaatgcctggaaccgatagagggaaaagtggtgcaatatgagaacctcaaatacaccgtcatcattacagtgcacacaggagaccaacaccaggtgggaaatgaaacgcagggagtcacggctgagataacgcctcaggcatcaactactgaagccatcttgcctgaatatggaacccttgggctagaatgctcaccacggacaggtttggatttcaatgaaatgatcttactaacaatgaagaacaaagcatggatggtacacagacaatggttttttgacctacctctaccatggacatcaggagctacaacagaaacaccaacttggaacaggaaggagctccttgtgacattcaaaaatgcacatgcgaaaaaacaagaagtggttgtccttggatcgcaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacggaggatggacaagggaaagctcacaatggcagactgatcacagccaacccagtggtgactaagaaggaggagcctgttaacattgaggctgaacctccttttggggaaagcaatatagtaattggaattggagacaatgctttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtgatgaaaattggaataggtgttctcttgacttggatagggttgaattcaaaaaacacatccatgtcattttcatgtattgcgataggaatcatcacactctatctgggagttgtggtacaagctgacatggggtgtgtcataaactggaaaggcaaagaacttaaatgtggaagtggaattttcgtcaccaacgaggtccatacctggacagagcagtacaaattccaagcggattccccaaaaagattggcgacagctattgcaggcgcttgggaaaatggagtgtgcggaattaggtcaacaaccagaatggagaacctcttgtggaagcaaatagccaatgaactgaattacatattatgggaaaacaatatcaaattaacggtagttgtgggcgacacaattggggtcttagagcaaggaaaaagaacactaacaccacaacccatggagctaaaatactcatggagaacgtggggaaaggcaaaaatagtgacagctgaaacacaaaattcctctttcataatagacgggccaaacacaccagagtgtccaagtgcctcaagagcatggaatgtgtgggaggtggaagattacgggttcggagtcttcacaaccaacatatggctgaaactccgagagatgtacacccaaatgtgtgaccataggctaatgtcggcagccgtcaaggatgagagggccgtgcatgccgacatgggctattggatagaaagccaaaagaatggaagttggaagctagaaaaagcatccctcatagaggtgaaaacctgcacatggccaaaatcacacactctttggagcaacggtgtgctagagagtgacatgatcattccaaagagtctagctggtcctatttcgcaacacaactacaggcccgggtaccacacccaaacggcaggaccctggcacttaggaaaattggagctggacttcaactattgtgaaggaacaacagttgtcatcacagaaaactgtgggacaagaggcccatcattgagaacgacaacagtgtcaggaaagttgatacacgaatggtgttgccgctcgtgcacacttcctcctctgcgatacatgggagaagacggctgttggtatggcatggagatcagacccatcagtgagaaagaagagaacatggtaaagtctttagtctcagcgggaagtggaaaggtagacaacttcacaatgggcgtcttgtgtttggcaatcctctttgaagaggtgatgagaggaaaatttgggaagaaacacatgattgcaggggttttcttcacgtttgtgctccttctttcagggcaaataacgtggagagacatggcgcacacactaataatgattgggtccaacgcctctgacaggatgggaatgggcgtcacctatctagctttaattgcaacatttaaaatccagccattcctggctttgggatttttcctaagaaaactgacatctagagaaaatttactgttaggagttggactggctatggcaacaacattacaactaccagaggacattgaacaaatggcaaatggaatcgccctggggctcatggctcttaaattgataacacaatttgaaacatatcaattatggacggcattaatctccttaacgtgttcaaatacaattttcacgttgactgttgcctggagaacagccaccctgattttggccggagtttcacttttaccagtgtgccagtcttcgagcatgaggaaaacagactggcttccaatgacagtggcagccatgggagtcccacccctaccactctttatttttagcttgaaagacacactcaaaaggagaagctggccgctgaatgaaggggtgatggctgttgggcttgtgagcattctggccagttctctccttagaaatgacgtgcccatggctggaccattagtggccgggggcttgctgatagcatgctacgtcataactggcacgtcagcagaccttacagtagaaaaagcagcagatgtaacatgggaggaagaggctgagcaaacaggagtgtcccacaacttaatgatcacagttgatgatgatggaacaatgagaataaaagatgatgagactgagaatattctaacagtgcttttgaagacagcattactaatagtatcaggtatctttccatactccatacccgcaacattgttggtctggcatacttggcaaaagcaaacccaaagatccggtgttctatgggacgtacccagtcccccagagacacagaaagcagaactggaggaaggggtctataggatcaaacagcaaggaattcttgggaaaacccaagtaggggttggagtacaaaaagaaggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggggaggaggtgcaggttatcgccgtagagcctgggaagaacccaaagaactttcaaaccatgccaggcacatttcagactacaacaggggaaataggagcaattgcactggatttcaagcctggaacttcagggtctcctatcataaacagagagggaaaggtagtgggactatatggcaatggagtggttacaaagaatggcggctacgtcagcggaatagcgcaaacaaatgcagaaccagatggaccgacgccagagttggaagaagagatgttcaaaaaacgaaatctaaccataatggatcttcatcctgggtcaggaaagacacggaaataccttccagccattgttagagaggcaatcaagagacgtttaagaactctaattttggcaccgacaagggtggttgcagctgagatggaagaagcattgaaagggctcccaataaggtaccaaacaacagcaacaaaatctgaacacacgggaagagagattgttgatctaatgtgccacgcaacgttcacaatgcgcttgctgtcaccagttagggttccaaattacaacttgataataatggatgaggctcatttcacagacccagccagtatagcggccagagggtacatatcaactcgtgttggaatgggagaggcagccgcaattttcatgacggcaacgccccctggaacagctgatgcctttcctcagagcaacgctccaattcaagatgaagaaagggacataccagaacgctcatggaattcaggcaatgaatggattaccgacttcgccgggaaaacggtgtggtttgtccccagcatcaaagccggaaatgacatagcaaactgcttgcgaaagaacgggaaaaaggtcattcaacttagtaggaagacttttgatacagaatatcagaagactaaactaaatgattgggactttgtggtgacaactgacatttcagaaatgggggccaatttcaaagcagatagagtgatcgacccaagaagatgtctaaaaccagtgatcctgacagatggaccagagcgggtgatcctggctggaccaatgccagtcaccgcggcgagtgctgcgcaaaggagagggagagttggtaggaacccacaaaaagaaaatgaccagtacatattcacgggccagcctctcaacaatgatgaagaccatgctcactggacagaagcaaaaatgttgctggacaacatcaacactccagaaggaatcataccagctctctttgaaccagaaagggagaagtcagccgccatagacggtgaatatcgcctgaagggtgaatccaggaagactttcgtggaactcatgaggaggggtgaccttccagtttggttagcccacaaagtagcatcagaagggatcaaatatacagatagaaaatggtgctttgatggacagcgcaacaatcaaattttagaggaaaacatggatgtggaaatctggacaaaggaaggagaaaagagaaaattaagacctaggtggcttgatgcccgcacttattcagatcccttagcactcaaggaattcaaggactttgcggctggcagaaagtcaatcgcccttgatcttgtgacagaaataggaagagtgccttcacacctagcccacagaacgagaaacgctctggacaatctggtgatgctgcacacgtcagaacatggcggtagggcctacaggcatgcggtggaggaactaccagaaacaatggaaacactcctactcttgggactcatgatcttactgacaggtggagcaacgcttttcttgatatcaggtaaaggtattggaaagacttcaataggactcatttgtgtgattgcttccagcggcatgctgtggatggccgaaatcccactccaatggatcgcgtcggctatagtcctggagttttttatgatggtgttgcttataccagaaccagaaaagcagagaaccccccaagacaaccaactcgcatatgtcgtaataggcatacttacattggctgcaataatagcggccaatgaaatgggactgctggaaactacaaagagagatttaggaatgtctaaggagccaggtgttgtttctccaactagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactactggcattgggttgctattcacaagtgaacccactgactctaacagcggcagtacttctgctaattacacattatgctattataggtccaggactgcaggcaaaagccactcgtgaagctcaaaaaaggacagctgctggaataatgaagaatccaacggtggatgggataataacaatagacctagatcctgtaatatatgattcaaaatttgaaaagcaactgggacaggtcatgctcctggttttgtgtgcagttcaactgttgttaatgagaacatcatgggccttgtgtgaagctttaactttagctacaggaccaataacaacactctgggaaggatcacctgggaagttttggaataccacgatagctgtttccatggcgaatatttttagagggagctatttagcacgagctgggcttgccttttctattatgaaatcagttggaacaggaaaaagaggaacaggctctcaaggtgaaactttaggagaaaaatggaaaaagaaattgaatcaattatcccggaaagagtttgacctttacaagaagtctggaatcactgaagtggatagaacagaagccaaagaagggttaaaaagaggagaaacaacacatcatgccgtgtccagaggtagtgcaaaacttcaatggtttgtggagagaaacatggtcattcctgaagggagagtcatagacctgggctgtggaagaggaggctggtcatattactgtgcaggactgaaaaaagtcacagaagtgcgaggatacacaaaaggcggtccaggacacgaagaaccagtgcctatgtcaacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctgaaaaacaaccagttttgcattaaagtattgaacccttacatgccagccgtgattgagcacctagaaagactacaaaggaaacacggaggaatgcttgtgagaaatccactttcacgaaactccacgcacgaaatgtactggatatctaatggtacaggtaacatcgtctcttcagtcaacatggtatccaaattattactgaacaggttcacgatgacacacaggagacctaccatagagaaagatgtggatttaggagcaggaactcgacatgttaatgcggaaccagaaacacccaacatggatgtcattggggaaagaataaaaaggatcaaggaggagcataactcaacatggcactatgatgacgaaaacccctacaaaacgtgggcttaccacggatcttatgaagtcaaggccacaggctcagcctcctccatgataaatggagtcgtgaaacttcttactaaaccatgggatgtggtgcccatggtgacacagatggcaatgacagatacaactccatttggccagcagagagtctttaaagagaaagtggacaccaggacacccaggcctatgccagggacaagaaaggttatggagatcacagcggagtggctctggagaaccctgggaagaaacaaaagacccaggttatgcacaagggaagagtttacaaaaaaggtcagaaccaacgcagccatgggcgccgtttttacagaggagaaccaatgggacagtgcgaaagctgctgttgaggatgaagaattttggaaacttgtggacagagaacgtgaactccacaaattgggcaagtgtggaagctgcgtttacaacatgatgggcaagagagagaagaaacttggagagtttggcaaagcaaaaggcagtagagctatatggtacatgtggttgggagccaggtaccttgagttcgaagcccttggattcctaaatgaagaccactggttctcgcgcgaaaactcttacagtggagtagaaggagaaggactgcacaaactaggctacatattaagggacatttccaagatacccggaggagccatgtatgctgatgacacagctggttgggacacaagaataacagaagatgacctgcacaatgaggaaaagatcacacagcaaatggaccctgaacacaggctgttagcgaacgctatatttaagctcacataccaaaacaaagtggtcaaagttcaacgaccgactccaacgggcacggtaatggacatcatatctaggaaagaccaaagaggcagtggacaggtgggaacttatggtctgaatacatttaccaatatggaagcccagttagtcagacaaatggaaggagaaggtgtgctgtcaaaggcagacctcgagaaccctcatctgccagaaaagaagattacacaatggttggaaaccaaaggagtggagaggttaaaaagaatggccattagcggggatgattgcgtagtgaaaccaatcgatgacaggttcgctaacgccctgcttgctctgaacgatatgggaaaggttcggaaagacatacctcaatggcagccatcaaagggatggcatgactggcagcaggttcctttctgctcccaccactttcatgaattgatcatgaaagatggaagaaagttggtggttccctgcagacctcaggacgaactaataggaagagcaagaatctctcaaggagcgggatggagccttagagaaaccgcatgtttggggaaagcctacgcccaaatgtggagtctcatgtattttcacagaagagatctcagactagcgtccaatgccatatgttcagcagtaccagtccactgggtccccacaagtagaacgacatggtctattcatgctcaccatcagtggatgaccacagaagacatgcttactgtttggaacagggtgtggatcgaggacaatccatggatggaagacaaaactccagttacaacctgggaaaatgttccatacctagggaagagagaagaccaatggtgcggatcacttattggtctcacctccagagcaacctgggcccagaacatacccacagcaattcaacaggtgagaagccttataggcaatgaagagtttctggattacatgccttcaatgaagagattcaggaaggaggaagagttggagggagccatttggtaa

SEQ ID NO: 7222 - RNA, 9873 nt, synthetic construct
  misc_feature 1..9873: note = derived and/or modified CDS sequence (wt) from DENV-3__KX380841__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagaaatgtgtgatgacacggtcacttacaaatgcccccacattaccgaagtggaacctgaagacattgactgctggtgcaaccttacatcaacatgggtgacttatggaacgtgtaatcaagctggagagcatagacgcgacaagagatcagtggcgttagctccccatgtcggcatgggactggacacacgcacccaaacctggatgtcggctgaaggagcttggagacaagtcgagaaggtagagacatgggcccttaggcatccagggttcaccatactagccctatttcttgcccattacataggcacctccttgacccagaaggtggttatttttatactactaatgctggtcaccccatccatgacaatgagatgtgtgggagtgggaaacagagattttgtggaaggtctgtcaggagctacgtgggttgacgtggtgctagagcacggggggtgtgtgaccaccatggctaagaacaagcccacgctggatatagagcttcagaagaccgaggccacccaactggcgaccctaaggaagctatgcattgaggggaaaattaccaatataacaactgactcaagatgtcccacccaaggggaagcggttttgcctgaggagcaggaccagaactacgtgtgtaagcacacatacgtagatagaggctgggggaacggttgtggtttgtttggcaagggaagcttggtaacatgtgcgaaatttcaatgcctggaaccgatagagggaaaagtagtgcaatatgagaacctcaaatacaccgtcatcattacagtgcacacaggagaccaacaccaggtgggaaatgaaacgcagggaatcacggctgagataacgcctcaggcatcaactactgaagccatcttgcctgaatatggaacccttgggctagaatgctcaccacggacaggtttggacttcaatgaaatgatcttactaacaatgaagaacaaagcatggatggtacacagacaatggttttttgacctacctctaccatggacatcaggagccacaacagaaacaccaacttggaacaggaaggagctccttgtgacattcaaaaatgcacatgcgaaaaaacaagaagtggttgtccttggatcgcaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgatcacagccaacccagtggtgactaagaaggaggagcctgtcaacattgaggctgaacctccttttggggaaagtaatatagtaattggaattggagacaatgccttgaaaatcaattggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtgatgaaaattggaataggtgttctcttaacttggatagggttgaattcaaaaaacacatccatgtcattttcatgcattgcaataggaatcatcacactctatttgggagctgtggtacaagctgacatggggtgtgtcataaactggaaaggcaaagaacttaaatgcggaagtggaattttcgtcaccaacgaggtccatacctggacagagcagtacaaattccaagcggattccccaaaaagattggcgacagctattgcaggcgcttgggaaaatggagtgtgtggaattaggtcaacaaccagaatggagaatctcttgtggaagcaaatagccaatgaactgaactacatattatgggaaaacaacatcaaattgacggtagttgtgggcgacacaatcggggttttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaaatgtgtgaccataggctaatgtcggcagccgtcaaggatgagagggccgtgcatgccgacatgggctactggatagaaagccaaaagaatggaagttggaagctagaaaaagcatccctcatagaggtgaaaacctgcacatggccaaaatcacacactctttggagcaacggtgtgctagagagtgacatgatcattccaaagagtctagctggtcctatttcgcaacacaactacaggcccgggtaccacacccaaacggcaggaccctggcacttaggaaaattggagctggacttcaactattgtgaaggaacaacagttgtcatcacagaaaattgtgggacaagaggcccatcattgagaacgacaacagtgtcaggaaagttgatacatgaatggtgttgccgctcgtgcacacttcctcccctgcgatacatgggagaagacggctgttggtatggcatggaaatcagacccatcagtgagaaagaagagaacatggtaaagtctttagtctcagcgggaagtggaaaggtagacaacttcacaatgggtgtcttgtgtttggcaatcctctttgaagaggtgatgagaggaaaatttgggaagaaacacatgattgcaggggttttcttcacgtttgtgctccttctctcagggcaaataacatggagagacatggcgcacacactaataatgattgggtccaacgcctctgacaggatgggaatgggcgtcacctatctagctttaattgcaacatttaaaatccagccattcctggctttgggatttttcctaagaaaactgacatctagagaaaatttactgttaggagttggactggctatggcaacaacgttacaattgccagaggacattgaacaaatggcaaatggaatcgccctggggctcatggctcttaaattgataacacaatttgaaacataccaattatggacagcattaatctccttaacgtgttcaaatacaattttcacgttgactgttgcttggagaacagccaccctgattttggccggagtttcacttttaccagtgtgccagtcttcgagcatgagaaaaacagactggcttccaatgacagtggcagctatgggagtcccacccctaccactctttatttttagcttgaaagacacactcaaaaggagaagctggccactgaatgaaggggtgatggctgttggacttgtgagcattctggccagttctctccttagaaatgacgtgcccatggctggaccattagtggccgggggcttgctgatagcgtgctacgtcataactggcacgtcagcagaccttacagtagaaaaagcagcagatgtaacatgggaggaagaggctgagcaaacaggagtgtcccacaacttaatgatcacagttgatgatgatggaacaatgagaataaaagatgatgagactgagaatattctaacagtgcttttgaagacagcattactaatagtatcaggtatctttccatactccataccagcgacattgttggtctggcatacttggcaaaagcaaacccaaagatccggtgttctatgggacgtacccagccccccagagacacagaaagcagaactggaagaaggggtctataggatcaaacagcaaggaattcttgggaaaacccaagtaggggttggagtacaaaaagacggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaatccaaagaacttccaaaccatgccaggcacattccagactacaacaggggaaataggagcaattgcattggatttcaagcctggaacttcagggtctcctatcataaacagagagggaaaggtagtgggactatatggcaatggagtggttacaaagaatggcggctacgtcagcggaatagcgcaaacaaatgcagaaccagatggaccgacgccagagttggaagaagagatgttcaaaaagcgaaatctaaccataatggatcttcatcctgggtcaggaaagacacggaaatatcttccagccattgttagagaggcaatcaagagacgtttaagaactctgattttggcaccgacaagggtggttgcagctgagatggaagaagcattgaaggggctcccaataaggtaccaaacaacagcaacaaaatctgaacatacgggaagagagattgttgatctaatgtgccacgcaacgttcacaatgcgcttgctgtcaccagttagggttccaaattacaacttgataataatggatgaggcccatttcacagacccagccagtatagcggccagagggtacatatcaactcgtgttggaatgggagaggcagccgcaatcttcatgacggcaacgccccctggaacagctgatgcctttcctcagagcaacgctccaattcaagatgaagaaagggacataccagagcgctcatggaactcaggcaatgaatggatcaccgacttcgccgggaaaacggtgtggtttgtccccagcatcaaagccggaaatgacatagcaaactgcttgcgaaagaacgggaaaaaggtcattcaacttagtaggaagacttttgatacagaatatcagaagactaaactaaatgactgggactttgtggtgacaactgacatttcagaaatgggggccaatttcaaagcagatagagtgatcgacccaagaagatgtctaaaaccagtgatcctgacagatggaccagagcgggtgatcctagctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacactccagaaggaatcataccagctctctttgaaccagaaagggagaagtcagccgccatagacggtgaatatcgcctgaagggtgaatccaggaagactttcgtggaactcatgaggaggggtgacctcccagtttggttagcccacaaagtagcatcagaagggatcaaatatacagataggaaatggtgctttgatggacagcgcaacaatcaaattttagaggaaaacatggacgtggaaatctggacaaaggaaggagaaaagaaaaaattaagacctaggtggcttgatgcccgcacttattcagatcccttagcactcaaggaattcaaggactttgcggctggcagaaagtcaatcgcccttgatcttgtgacagaaataggaagagtgccttcacacctagcccacagaacgagaaacgctctggacaatctggtgatgctgcacacgtcagaacatggcggtagggcctacaggcatgcggtggaggaactaccagaaacaatggaaacactcctactcttgggactcatgatcttactgacaggtggagcaatgcttttcttgatatcaggtaaagggattggaaagacttcaataggactcatttgtgtgattgcttccagcggcatgctgtggatggccgaaattccactccaatggatcgcgtcggctatagtcctggagttttttatgatggtgttgcttataccagaaccagaaaagcagagaaccccccaagacaaccaactcgcatatgtcgtaataggcatacttacaatggctgcaataatagcggccaatgaaatgggactattggaaactacaaagagagatctaggaatgtctaaggaaccaggtgttgtttctccaactagctatttggatgtggatttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactactggcattgggttgctattcacaagtgaacccactgactctaacagcggcagtacttttgctagttacacattatgctattataggtccaggactgcaggcaaaagccactcgtgaagctcaaaaaaggacagctgctggaataatgaagaatccaacggtggatgggataataacaatagacctagaccctgtaatatatgattcaaaatttgaaaagcaactgggacaggtcatgctcctggttttgtgtgcagttcaactgttgttaatgagaacatcatgggccttgtgtgaagctttaactttagctacaggaccaataacaacactctgggaaggatcacctgggaagttttggaataccacgatagctgtttccatggcgaacatttttagagggagctatttagcaggagctgggcttgctttttctattatgaaatcagttggaacaggaaaaagaggaacaggctctcaaggtgaaactttaggagaaaaatggaaaaagaaattgaatcaattatcccggaaagagtttgacctttacaagaagtctggaatcactgaagtggatagaacagaagccaaagaagggttgaaaagaggagaaacaacacatcatgccgtgtccaggggtagtgcaaaacttcaatggtttgtggaaaggaacatggtcattcccgagggaagagtcatagacctgggctgtggaagaggaggctggtcatattactgtgcaggactgaaaaaagtcacagaagtgcgaggatacacaaaaggcggtccaggacacgaagaaccagtgcctatgtcaacatatggatggaacatagttaaattaatgagtggaaaggatgtgttttatcttccgcctgaaaagtgtgacaccctgttgtgtgacattggagaatcttcaccaagcccaacagtggaagaaagcagaactataagagttttgaagatggttgaaccatggctgaaaaacaaccagttttgcattaaagtattgaacccttacatgccagccgtgattgagcacctagaaagactgcaaaggaaacacggaggaatgcttgtgagaaatccactttcacgaaactccacgcacgaaatgtactggatatctaatggtacaggtaacattgtctcttcagttaacatggtatccagattgttactgaacaggttcacgatgacacacaggagacctaccatagagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccacggatcttatgaagtcaaggccacaggctcagcctcctccatgataaacggagtcgtgaaacttctcactaaaccatgggatgtagtgcccatggtgacacagatggcaatgacagatacaactccatttggccagcagagagtctttaaagagaaggtggacaccaggacacccaggcctatgccagggacaagaaaggttatggagatcacagcggagtggctctggagaaccctgggaaggaacaaaagacccaggttatgcacaagggaagagttcacaaaaaaggtcagaaccaacgcagccatgggcgccgttttcacagaggagaaccaatgggacagtgcgaaagccgctgttgaggatgaagagttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcacacagcaaatggaccctgaacacaggctgttagcgaacgctatatttaagctcacataccaaaacaaagtggtcaaagttcaacgaccgactccaacgggcacggtaatggacattatatctaggaaagaccaaagaggcagtggacaggtgggaacttatggtctgaacacatttactaacatggaagcccagttagtcagacaaatggaaggagaaggtgtgctgtcaaagacagacctcgagaaccctcatctgccagaaaagaaaattacacaatggctggaaaccaaaggagtggagaggttaaaaagaatggccattagcggggatgattgcgtagtgaaaccaatcgatgacaggttcgctaacgccctgcttgccctgaacgatatgggaaaggttcggaaagacatacctcaatggcagccatcaaagggatggcatgactggcagcaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtttggggaaagcctacgcccaaatgtggagtctcatgtattttcacagaagagatctcagactagcgtccaatgccatatgttcagcagtaccagtccactgggtccccacaagtagaacgacatggtctattcatgctcaccatcagtggatgaccacagaagacatgcttactgtttggaacagggtgtggatcgaggacaatccatggatggaagacaaaactccaattacaacctgggaaaatgttccatacctagggaagagggaagaccaatggtgcggatcacttattggtctcacttccagagcaacctgggcccagaacatacccacagcaattcaacaggtgagaagccttataggcaatgaagagtttctggactacatgccttcaatgaagagattcaggaaggaggaggagtcggagggagccatttggtaa

SEQ ID NO: 7223 - RNA, 9873 nt, synthetic construct
  misc_feature 1..9873: note = derived and/or modified CDS sequence (wt) from DENV-3__KX380842__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagaaatgtgtgatgacacggtcacttacaaatgcccccacattaccgaagtggaacctgaagacattgactgctggtgcaaccttacatcaacatgggtgacttatggaacgtgtaatcaagctggagagcatagacgcgacaagagatcagtggcgttagctccccatgtcggcatgggactggacacacgcacccaaacctggatgtcggctgaaggagcttggagacaagtcgagaaggtagagacatgggcccttaggcatccagggttcaccatactagccctatttcttgcccattacataggcacctccttgacccagaaggtggttatttttatactactaatgctggtcaccccatccatgacaatgagatgtgtgggagtgggaaacagagattttgtggaaggtctgtcaggagctacgtgggttgacgtggtgctagagcacggggggtgtgtgaccaccatggctaagaacaagcccacgctggatatagagcttcagaagaccgaggccacccaactggcgaccctaaggaagctatgcattgaggggaaaattaccaacataacaactgactcaagatgtcccacccaaggggaagcggttttgcctgaggagcaggaccagaactacgtgtgtaagcacacatacgtagatagaggctgggggaacggctgtggtttgtttggcaagggaagcttggtaacatgtgcgaaatttcaatgcctggaaccgatagagggaaaagtagtgcaatatgagaacctcaaatacaccgtcatcattacagtgcacacaggagaccaacaccaggtgggaaatgaaacgcagggaatcacggctgagataacgcctcaggcatcaactactgaagccatcttgcctgaatatggaacccttgggctagaatgctcaccacggacaggtttggacttcaatgaaatgatcttactaacaatgaagaacaaagcatggatggtacacagacaatggttttttgacctacctctaccatggacatcaggagccacaacagaaacaccaacttggaacaggaaggagctccttgtgacattcaaaaatgcacatgcgaaaaaacaagaagtagttgtccttggatcgcaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgatcacagccaacccagtggtgactaagaaggaggagcctgtcaacattgaggctgaacctccttttggggaaagtaatatagtaattggaattggagacaatgccttgaaaatcaattggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtgatgaaaattggaataggtgttctcttaacttggatagggttgaattcaaaaaacacatccatgtcattttcatgcattgcaataggaatcatcacactctatttgggagctgtggtacaagctgacatggggtgtgtcataaactggaaaggcaaagaacttaaatgcggaagtggaattttcgtcaccaacgaggtccatacctggacagagcagtacaaattccaagcggattccccaaaaagattggcgacagctattgtaggtgcttgggaaaatggagtgtgtggaattaggtcaacaaccagaatggagaatctcttgtggaagcaaatagccaatgaactgaactacatattatgggaaaacaacatcaaattaacggtagttgtgggcgacacaatcggggttttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaaatgtgtgaccataggctaatgtcggcagccgtcaaggatgagagggccgtgcatgccgacatgggctactggatagaaagccaaaagaatggaagttggaagctagaaaaagcatccctcatagaggtgaaaacctgcacatggccaaaatcacacactctttggagcaacggtgtgctagagagtgacatgatcattccaaagagtctagctggtcctatttcgcaacacaactacaggcccgggtaccacacccaaacggcaggaccctggcacttaggaaaattggagctggacttcaactattgtgaaggaacaacagttgtcatcacagaaaattgtgggacaagaggcccatcattgagaacgacaacagtgtcaggaaagttgatacatgaatggtgttgccgctcgtgcacacttcctcccctgcgatacatgggagaagacggctgttggtatggcatggaaatcagacccatcagtgagaaagaagagaacatggtaaagtctttagtctcagcgggaagtggaaaggtagacaacttcacaatgggtgtcttgtgtttggcaatcctctttgaagaggtgatgagaggaaaatttgggaagaaacacatgattgcaggggttttcttcacgtttgtgctccttctctcagggcaaataacatggagagacatggcgcacacactaataatgattgggtccaacgcctctgacaggatgggaatgggcgtcacctatctagctttaattgcaacatttaaaatccagccattcctggctttgggatttttcctaagaaaactgacatctagagaaaatttactgttaggagtcggactggctatggcaacaacgttacaattgccagaggacattgaacaaatggcaaatggaatcgccctggggctcatggctcttaaattgataacacaatttgaaacataccaattatggacagcattaatctccttaacgtgttcaaatacaattttcacgttgactgttgcttggagaacagccaccctgattttggccggagtttcacttttaccagtgtgccagtcttcgagcatgagaaaaacagactggcttccaatgacagtggcagctatgggagtcccacccctaccactctttatttttagcttgaaagacacactcaaaaggagaagctggccactgaatgagggggtgatggctgttggacttgtgagcatgctggccagttctctccttagaaatgacgtgcccatggctggaccattagtggccgggggcttgctgatagcgtgctacgtcataactggcacgtcagcagaccttacagtagaaaaagcagcagatgtaacatgggaggaagaggctgagcaaacaggagtgtcccacaacttaatgatcacagttgatgatgatggaacaatgagaataaaagatgatgagactgagaatattctaacagtgcttttgaagacagcattactaatagtatcaggtatctttccatactccataccagcgacattgttggtctggcatacttggcaaaagcaaacccaaagatccggtgttctatgggacgtacccagccccccagagacacagaaagcagaactggaagaaggggtctataggatcaaacagcaaggaattcttgggaaaacccaagtaggggttggagtacaaaaagacggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaatccaaagaacttccaaaccatgccaggcacattccagactacaacaggggaaataggagcaattgcattggatttcaagcctggaacttcagggtctcctatcataaacagagagggaaaggtagtgggactatatggcaatggagtggttacaaagaatggcggctacgtcagcggaatagcgcaaacaaatgcagaaccagatggaccgacgccagagttggaagaagagatgttcaaaaagcgaaatctaaccataatggatcttcatcctgggtcaggaaagacacggaaatatcttccagccattgttagagaggcaatcaagagacgtttaagaactctgattctggcaccgacaagggtggttgcagctgagatggaagaagcattgaaggggctcccaataaggtaccaaacaacagcaacaaaatctgaacatacgggaagagagattgttgatctaatgtgccacgcaacgttcacaatgcgcttgctgtcaccagttagggttccaaattacaacttgataataatggatgaggcccatttcacagacccagccagtatagcggccagagggtacatatcaactcgtgttggaatgggagaggcagccgcaatcttcatgacggcaacgccccctggaacagctgatgcctttcctcagagcaacgctccaattcaagatgaagaaagggacataccagaacgctcatggaattcaggcaatgaatggatcaccgacttcgccgggaaaacggtgtggtttgtccccagcatcaaagccggaaatgacatagcaaactgcttgcgaaagaacgggaaaaaggtcattcaacttagtaggaagacttttgatacagaatatcagaagactaaactaaatgactgggactttgtggtgacaactgacatttcagaaatgggggccaatttcaaagcagatagagtgatcgacccaagaagatgtctaaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgacgaagaccatgctcactggacagaagcaaaaatgctgctggacaacatcaacactccagaaggaatcataccagctctctttgaaccagaaagggagaagtcagccgccatagacggtgaatatcgcctgaagggtgaatccaggaagactttcgtggaactcatgaggaggggtgacctcccagtttggttagcccacaaagtagcatcagaagggatcaaatatacagataggaaatggtgctttgatggacagcgcaacaatcaaattttagaggaaaacatggacgtggaaatctggacaaaggaaggagaaaagaaaaaattaagacctaggtggcttgatgcccgcacttattcagatcccttagcactcaaggaattcaaggactttgcggcaggcagaaagtcaatcgcccttgatcttgtgacagaaataggaagagtgccttcacacctagcccacagaacgagaaacgctctggacaatctggtgatgctgcacacgtcagaacatggcggtagggcctacaggcatgcggtggaggaactaccagaaacaatggaaacactcctactcttgggactcatgatcttactgacaggtggagcaatgcttttcttgatatcaggtaaagggattggaaagacttcaataggactcatttgtgtgattgcttccagcggcatgctgtggatggccgaaattccactccaatggatcgcgtcggctatagtcctggagttttttatgatggtgttgcttataccagaaccagaaaagcagagaaccccccaagacaaccaactcgcatatgtcgtaataggcatacttacaatggctgcaataatagcggccaatgaaatgggactattggaaactacaaagagagatctaggaatgtctaaggaaccaggtgttgtttctccaactagctatttggatgtggatttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactactggcattgggttgctattcacaagtgaacccactgactctaacagcggcagtacttttgctagttacacattatgctattataggtccaggactgcaggcaaaagccactcgtgaagctcaaaaaaggacagctgctggaataatgaagaatccaacggtggatgggataataacaatagacctagaccctgtaatatatgattcaaaatttgaaaagcaactgggacaggtcatgctcctggttttgtgtgcagttcaactgttgttaatgagaacatcatgggccttgtgtgaagctttaactttagctacaggaccaataacaacactctgggaaggatcacctgggaagttttggaataccacgatagctgtttctatggcgaacatttttagagggagctatttagcaggagctgggcttgccttttctattatgaaatcagttggaacaggaaaaagaggaacaggctctcaaggtgaaactttaggagaaaaatggaaaaagaaattgaatcaattatcccggaaagagtttgacctttacaagaagtctggaatcactgaagtggatagaacagaagccaaagaagggttgaaaagaggagaaacaacacatcatgccgtgtccaggggtagtgcaaaacttcaatggtttgtggaaaggaacatggtcattcccgagggaagagtcatagacctgggctgtggaagaggaggctggtcatattactgtgcaggactgaaaaaagtcacagaagtgcgaggatacacaaaaggcggtccaggacacgaagaaccagtgcctatgtcaacatatggatggaacatagttaaattaatgagtggaaaggatgtgttttatcttccgcctgaaaagtgtgacaccctgttgtgtgacattggagaatcttcaccaagcccaacagtggaagaaagcagaactataagagttttgaagatggttgaaccatggctaaaaaacaaccagttttgcattaaagtattgaacccttacatgccagccgtgattgagcacctagaaagactgcaaaggaaacacggaggaatgcttgtgagaaatccactttcacgaaactccacgcacgaaatgtactggatatctaatggtacaggtaacattgtctcttcagttaacatggtatccagattgttactgaacaggttcacgatgacacacaggagacctaccatagagaaagatgtggatttaggagcaggaactcgacatgtcaatgcggaaccagaaacacccaacatggatgtcattggggaaagaataaaaaggatcaaggaggagcataattcaacatggcactatgatgacgaaaacccctacaaaacgtgggcttaccacggatcttatgaagtcaaggccacaggctcagcctcctccatgataaacggagtcgtgaaacttctcactaaaccatgggatgtagtgcccatggtgacacagatggcaatgacagatacaactccatttggccagcagagagtctttaaagagaaggtggacaccaggacacccaggcctatgccagggacaagaaaggttatggagatcacagcggagtggctctggagaaccctgggaaggaacaaaagacccaggttatgcacaagggaagagttcacaaaaaaggtcagaaccaacgcagccatgggcgccgttttcacagaggagaaccaatgggacagtgcgaaagccgctgttgaggatgaagagttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcacacaacaaatggaccctgaacacaggctgttagcgaacgctatatttaagctcacataccaaaacaaagtggtcaaagttcaacgaccgactccaacgggcacggtaatggacattatatctaggaaagaccaaagaggcagtggacaggtgggaacttatggtctgaacacatttactaacatggaagcccagttagtcagacaaatggaaggagaaggtgtgctgtcaaagacagacctcgagaaccctcatctgccagaaaagaaaattacacaatggctggaaaccaaaggagtggagaggttaaaaagaatggccattagcggggatgattgcgtagtgaaaccaatcgatgacaggttcgctaacgcactgcttgccctgaacgatatgggaaaggttcggaaagacatacctcaatggcagccatcaaagggatggcatgactggcagcaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtttggggaaagcctacgcccaaatgtggagtctcatgtattttcacagaagagatctcagactagcgtccaatgccatatgttcagcaataccagtccactgggtccccacaagtagaacgacatggtctattcatgctcaccatcagtggatgaccacagaagacatgcttactgtttggaacagggtgtggatcgaggacaatccatggatggaagacaaaactccaattacaacctgggaaaatgttccatacctagggaagagggaagaccaatggtgcggatcacttattggtctcacttccagagcaacctgggcccagaacatacccacagcaattcaacaggtgagaagccttataggcaatgaagagtttctggactacatgccttcaatgaagagattcaggaaggaggaggagtcggagggagccatttggtaa

SEQ ID NO: 7224 - RNA, 9873 nt, synthetic construct
  misc_feature 1..9873: note = derived and/or modified CDS sequence (wt) from DENV-3__KX380839__SS-prME
  source 1..9873: mol_type = other RNA
acatcgctctgtctcatgatgatgttaccagcaacacttgctttccacttgacttcacgagatggagagccgcgcatgattgtggggaagaatgaaagaggaaaatccctactatttaagacagcctctggaatcaacatgtgcacactcatagccatggatttgggagaaatgtgtgatgacacgatcacttacaaatgccccctcattactgaagtggagcctgaagacattgactgctggtgcaacctcacatcgacgtgggtgacctacggaacgtgcaaccaagctggagagcatagacgcgataagagatcggtggcgttagctcctcatgtcggcatgggactggacacacgcgcccagacctggatgtcggctgaaggagcttggagacaagtcgagaaggtagagacatgggcctttaggcacccagggttcacaatactagctctatttcttgcccattacataggcacttccttgacccagaaagtggtcattttcatactactaatgctggtcaccccatccatgacaatgagatgtgtgggagtaggaaacagagattttgtggaaggcctatcaggagctacgtgggttgacgtggtgctcgaacacggtgggtgtgtgaccaccatggctaagaacaagcccacgctggacatagagctccagaagaccgaggccacccaactggcaaccctaaggaaactatgtattgagggaaaaatcaccaatgtgacaaccgactcaaggtgccccactcaaggggaagcgactctacctgaggagcaggaccagaactacgtgtgtaagcacacatacgtggacagaggctggggaaatggttgtggtttgtttggcaagggaagcttggtaacatgcgcaaaattccaatgtttggaattaacagagggaaaagtggtgcagcacgagaacctcaaatacaccgtcatcatcacagtgcacacaggagaccaacaccaggtgggaaatgaaacgcagggagtcacggctgagataacaccccaggcttcaaccgtcgaagccatcttccgatcttatggaacccttgggctagaatgctcaccacggacaggtttggatttcaatgaaatgattttgctgacaatgaagaacaaagcatggatggtacatagacaatggttttttgacctacctctaccatggacatcaggggctacaacagaaacaccaacctggaacaagaaagagcttcttgtgacattcaaaaacgcacacgcaaaaaaacaagaagtagttgtccttggatcgcaagagggagcaatgcatacagcactgacaggagctacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggtcgagtacaaaggggaagacgcaccttgcaagattcctttctccacggaggatggacaagggaaagcccacaatggcagactgatcacagctaacccagtggtgaccaagaaggaggaacctgtcaatattgaggcagaacctccttttggggaaagcaacataataattggaattggagacaaagccttgaaaatcaattggtacaagaagggaagctcgattgggaagatgttcgaggccactgccagaggggcaaggcgcatggctatcttgggagacacagcctgggactttggatcagtaggtggtgtcttaaattcactagggaaaatggtgcaccagatatttggaagtgcttacacggccctttttagtggagtctcctggataatgaaaattggaataggtgtccttttaacttggatagggttgaattcaaaaaacacttctatgtcattttcatgcattgtgataggaatcatcacactctatctaggagccgtggtgcaagctgacatggggtgtgtcataaactggaaaggcaaagaactcaaatgtggaagtggaattttcgttaccaatgaagtccacacctggacagagcaatacaaatttcaagcagactcccccaaaagactggcgacagccattgcaggcgcctgggagaatggagtgtgcggaatcaggtcgacaaccagaatggagaacctcttgtggaagcaaatagctaatgaactaaactacatattatgggaaaacaacatcaaattaacggtagttgtgggtgatataattgggatcttagagcaagggaaaagaacactaacaccacaacccatggagctaaaatattcatggaaaacatggggaaaggcgaaaatagtgacagctgaaacacaaaattcctcttttataatagatgggccaaacacaccggagtgcccaaatgcctcaagagcatggaatgtgtgggaagtggaagattacggcttcggagtcttcacaaccaatatatggctgaaactccgagaaatgtacacccaactatgtgaccacaggctaatgtcggcagccgttaaggatgagagagccgtacacgccgacatgggctattggatagaaagccaaaagaatggtagttggaagctagaaaaggcatctctcatagaggtaaaaacctgcacatggccaaaatcacacactctctggagcaatggtgtgttggagagtgatatgatcatcccaaagagtctggctggtcctatctcgcaacacaattacaggcctggataccacacccaaacggcaggaccatggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacacttcctcccctgcgatatatgggagaagacggctgctggtatggcatggaaattagacccattaatgagaaagaagagaatatggtaaaatctttagtctcagcagggagtggaaaggtggataacttcacaatgggtgtcttgtgtcttgcaatcctctttgaagaggtaatgagaggaaaattcgggaaaaagcacatgattgcaggggttcttttcacatttgtgctccttctctcagggcaaataacatggagagacatggcgcgcacactcataatgattggatccaacgcctctgacagaatgggaatgggcgtcacttacctagcattgattgcaacatttaaaatccagccatttttggctttgggattctttctgaggaaactgacatctagagaaaatttattattaggagttgggttagccatggcaacaacgttgcaactgccagaggacattgaacaaatggcgaatggaatagccttggggctcatggctctcaaattgataacacaatttgaaacataccaactatgggcggcattagtctccctaatgtgttcaaacacaattttcacgttgactgttgcctggagaacagccaccctgatcttggccggaatttcgcttttgccaatgtgccagtcctcgagcatgaggaaaacagattggctcccaatgactgtggcagctatgggagttccacctctaccactttttattttcagtttgaaagacacactcaaaaggagaagctggccactgaatgagggggtgatggccgttggacttgtgagcattctagcaagctctctccttaggaatgacgtacccatggctggaccattagtggctgggggcctgctgatagcatgctacgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgctcttgaaaacagcattactaatagtgtcaggcatttttccatactccatacctgcaacacttctggtctggcacacttggcaaaagcaaacccaaagatccggcgtcctgtgggacgtacccagccccccagagacacagaaagcagaactggaagagggggtttataggatcaagcagcaaggaatttttggaaagacccaagtgggagttggagtacaaaaagaaggagttttccacaccatgtggcatgtcacaagaggagcagtgttgacacacaatggaaaaagactggaaccaaactgggctagcgtgaaaaaagatctgatttcatacggaggaggatggagactgagtgcacaatggcaaaaaggagaagaggtgcaggttattgccgtagagcctgggaagaacccaaaaaactttcaaaccatgccaggcattttccagacaacaacaggggagataggagcgattgcactggacttcaagcctggaacctcaggatctcccatcataaacagagagggaaaggtagtgggactatatggcaacggagtggttacaaagaatggtggctatgtcagtggaatagctcaaacaaacgcagaaccagacggaccgacaccagagctggaagaagagatgttcaaaaagcgaaatctaaccataatggatctccatcctgggtcaggaaagacgcggaaataccttccagctatagttagagaggcaatcaagagacgcttaaggactctaattttagcaccaacaagggtggttgcagctgagatggaagaagcattgaaggggctcccaataaggtatcaaacaactgcaacaaaatctgaacacacagggaaagagattgttgacctaatgtgtcacgcaacgttcacaatgcgtttactgtcaccagtcagagttccaaactacaacttgataataatggatgaggctcatttcacagatccagctagtatagcggctagagggtacatatcaactcgtgtaggaatgggagaggcagccgcaattttcatgacagccacacctcctggaacagctgaagcctttcctcagagcaacgctccaattcaagatgaagaaagagacataccagaacgctcatggaattcaggcaatgattggattaccgactttgccggaaagactgtgtggtttgtccccagcatcaaagctgggaatgacatagcaaactgcttgcggaaaaatggaaaaaaggtcattcaacttagtaggaaaacttttgacacagaatatcaaaagaccaaactaaatgattgggactttgtggtgacaacagacatttcagaaatgggagccaatttcaaagcagacagagtgatcgacccaagaagatgtctcaaaccagtcatcttgacagacggacccgagcgcgtgatcctggcgggaccaatgccagtcaccgtggcgagtgctgcgcaaaggagagggagagttggcaggaacccacaaaaagaaaatgaccaatacatattcacgggccagcctctcaacaatgatgaagaccacgctcactggacggaagcaaaaatgctgctagacaacatcaacacaccagaaggaatcataccagctctctttgaaccagaaagggagaagtcagccgccatagacggcgaataccgcctgaaaggtgagtccaggaagacctttgtggaactcatgaggaggggtgatctcccagtttggctagctcataaagtagcatcagaagggatcaaatacacagacagaaaatggtgttttgatggagagcgcaacaatcaaattttagaggagaacatggatgtggaaatctggacaaaggaaggagaaaagaaaaaattgaggcctaggtggcttgatgcccgcacttattcagatcccttagcgctcaaggaattcaaggactttgcggctggtagaaagtcgatcgcccttgatcttgtgacagaaataggaagagtgcctccacatttagctcacagaacgagaaacgctctggacaatctggtgatgttgcacacgtcagaatacggtgggagggcctacaggcatgcagtggaggaattaccagaaacaatggaaacactcttactcctgggactcatgatcctgttaacaggtggggtgatgcttttcttgatatcaggcaaaggggttggaaagacttcaataggactcatttgtgtagttgcttccagtggcatgttatggatggctgatatcccactccaatggatcgcgtcggccatagttctggagttttttatgatggtgctacttataccagaaccagaaaagcagagaactccccaagacaatcaactcgcatatgtcgtgataggcatacttacattggctgcaatagtagcagccaatgaaatgggattgttggaaaccacaaagagagatttggggatgtccaaagaaccaggtgttgtttcgccaaccagctatttggatgtggatctgcacccagcatcagcctggacattgtacgctgtggccacaacagtaataacaccaatgttgagacacaccatagagaattccacagcaaatgtgtccctggcagccatagccaaccaggcagtggtcctgatgggtctagacaaaggatggccgatatcgaaaatggacttaggcgtgccactattagcactgggttgctattcacaagtgaacccactgactctcacagcggcagtgctcctgctagtcacgcactacgctattataggcccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttaatgagaacatcatgggcattttgtgaagctctgaccctagccacaggaccaataacaacactctgggaaggatcacctgggaagttctggaacaccacgatagctgtttccatggcaaacatctttagagggagctatttagcaggagctgggcttgctttttccatcatgaaatcagttggaacaggaaagagaggaacagggtcacaaggtgaaactttgggagaaaagtggaaaaagaaattgaatcaattatcccggaaagagtttgacctctacaaaaaatccggaatcactgaagtggatagaacagaagccaaagaagggttaaaaagaggagaaataacacaccatgccgtatccagaggcagcgcaaaacttcaatggttcgtggagagaaacatggtcattcctgaaggaagagtcatagacttgggctgtggaagaggaggctggtcatattattgtgcagggttgaaaaaagttacagaagtgcgaggatacacaaaaggcggcccaggacatgaagaaccagtacctatgtctacatatggatggaacatagtcaagctgattagtggaaaggatgtgttttatcttccacctgaaaagtgtgacaccctactgtgtgacattggagaatcatcaccaagcccaacagtggaggagagcagaaccataagagtcttgaaaatggttgaaccatggctaaaaaataaccagttttgcattaaagtattgaacccttacatgccagctgtgattgagcacctagaaagactacaaaggaaacatggaggaatgcttgtgagaaatccactctcacgaaactccacgcacgaaatgtactggatatctaatggcacaggcaacatcgtctcttcagtcaacatgatatccagactgctactgaacagattcacaatgacatataggagacccaccatagagaaagatgtggatttgggagcggggacccgacatgtcaatgcggaaccagaaacacccaacatggatgtcattggggaaagaataagaaggattaaggaggagcatagttcaacatggcactatgatgatgaaaatccttataaaacgtgggcttaccatggatcttatgaagtcaaggccacaggctcagcctcctccatgataaatggagtcgtgaaactcctcacgaaaccatgggatgtggtgcccacggtgacacagatggcaatgacggacacgaccccttttggccagcaaagagtttttaaagagaaagtggacaccaggacacccaaacccatgccaggaacaagaaaggttatggagatcacagcggaatggctttggagaaccttgggaaggaacaaaagacccagattatgcacgagagaagagttcacaaaaaaggtcagaaccaacgcagctatgggcgccgtattcacagaggagaaccaatgggacagtgctagagctgccgttgaagatgaagaattctggaaactcgtggacagagaacgtgaactccacaaactgggcaagtgtggaagctgtgtttataacatgatgggcaagagagagaagaaacttggagagtttggcaaagcaaaaggcagtagagccatatggtacatgtggttgggagccaggtaccttgagttcgaggcactcggatttttaaatgaagaccattggttctcgcgtgaaaactcttacagtggagtagaaggggaaggactgcataagctgggatatatcttgagagatatttccaagatacccggaggagctatgtatgctgatgacacagcagggtgggacacaagaataacagaagatgacctgcacaatgaggaaaaaattacacagcaaatggaccctgaacacaggcagttagcaaacgctatatttaagctcacttaccaaaacaaagtggtcaaagttcaacgaccaactccaaaaggcacggtaatggacatcatatctaggaaagaccaaagaggcagtggacaggtgggaacctatggtctaaatacattcaccaacatggaagcccagttgatcagacagatggaaggagaaggtgtgttgtcgaagacagacctcgagaaccctcatctgctagagaagaaaatcacacaatggttggaaaccaaaggagtggagaggttaaaaagaatggccatcagtggagatgattgcgtggtgaaaccaatcgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtggtcccctgcagacctcaggacgaattaatagggagagcaagaatctctcagggagcaggatggagccttaaagaaactgcatgcttagggaaagcctacgcccaaatgtgggctctcatgtattttcacagaagagatcttagactagcatccaatgccatatgttcagcagtaccagtccattgggtccccacaagcagaacgacgtggtccatccatgctcaccatcagtggatgactacagaagacatgcttactgtttggaacagggtgtggatagaggacaatccatggatggaagacaaaactccagtcacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccttcgatgaagagattcaggaaggaggaggagtcagagggagccatttggtaa

SEQ ID NO: 7225 - RNA, 9873 nt, synthetic construct
  misc_feature 1..9873: note = derived and/or modified CDS sequence (wt) from DENV-3__KX380840__SS-prME
  source 1..9873: mol_type = other RNA
acatcgctctgtctcatgatgatgttaccagcaacacttgctttccacttgacttcacgagatggagagccgcgcatgattgtggggaagaatgaaagaggaaaatccctactatttaagacagcctctggaatcaacatgtgcacactcatagccatggatttgggagaaatgtgtgatgacacgatcacttacaaatgccccctcattactgaagtggagcctgaagacattgactgctggtgcaacctcacatcgacgtgggtgacctacggaacgtgcaaccaagctggagagcatagacgcgataagagatcggtggcgttagctcctcatgtcggcatgggactggacacacgcgcccagacctggatgtcggctgaaggagcttggagacaagtcgagaaggtagagacatgggcctttaggcacccagggttcacaatactagctctatttcttgcccattacataggcacttccttgacccagaaagtggtcattttcatactactaatgctggtcaccccatccatgacaatgagatgtgtgggagtaggaaacagagattttgtggaaggcctatcaggagctacgtgggttgacgtggtgctcgaacacggtgggtgtgtgaccaccatggctaagaacaagcccacgctggacatagagctccagaagaccgaggccacccaactggcaaccctaaggaaactatgtattgagggaaaaatcaccaatgtgacaaccgactcaaggtgccccactcaaggggaagcgactctacctgaggagcaggaccagaactacgtgtgtaagcacacatacgtggacagaggctggggaaatggttgtggtttgtttggcaagggaagcttggtaacatgcgcaaaattccaatgtttggaattaacagagggaaaagtggtgcagcacgagaacctcaaatacaccgtcatcatcacagtgcacacaggagaccaacaccaggtgggaaatgaaacgcagggagtcacggctgagataacaccccaggcttcaaccgtcgaagccatcttccgatcttatggaacccttgggctagaatgctcaccacggacaggtttggatttcaatgaaatgattttgctgacaatgaagaacaaagcatggatggtacatagacaatggttttttgacctacctctaccatggacatcaggggctacaacagaaacaccaacctggaacaagaaagagcttcttgtgacattcaaaaacgcacacgcaaaaaaacaagaagtagttgtccttggatcgcaagagggagcaatgcatacagcactgacaggagctacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggtcgagtacaaaggggaagacgcaccttgcaagattcctttctccacggaggatggacaagggaaagcccacaatggcagactgatcacagctaacccagtggtgaccaagaaggaggaacctgtcaatattgaggcagaacctccttttggggaaagcaacataataattggaattggagacaaagccttgaaaatcaattggtacaagaagggaagctcgattgggaagatgttcgaggccactgccagaggggcaaggcgcatggctatcttgggagacacagcctgggactttggatcagtaggtggtgtcttaaattcactagggaaaatggtgcaccagatatttggaagtgcttacacggccctttttagtggagtctcctggataatgaaaattggaataggtgtccttttaacttggatagggttgaattcaaaaaacacttctatgtcattttcatgcattgtgataggaatcatcacactctatctaggagccgtggtgcaagctgacatggggtgtgtcataaactggaaaggcaaagaactcaaatgtggaagtggaattttcgttaccaatgaagtccacacctggacagagcaatacaaatttcaagcagactcccccaaaagactggcgacagccattgcaggcgcctgggagaatggagtgtgcggaatcaggtcgacaaccagaatggagaacctcttgtggaagcaaatagctaatgaactaaactacatattatgggaaaacaacatcaaattaacggtagttgtgggtgatataattgggatcttagagcaagggaaaagaacactaacaccacaacccatggagctaaaatattcatggaaaacatggggaaaggcgaaaatagtgacagctgaaacacaaaattcctcttttataatagatgggccaaacacaccggagtgcccaaatgccttaagagcatggaatgtgtgggaagtggaagattacggcttcggagtcttcacaaccaatatatggctgaaactccgagaaatgtacacccaactatgtgaccacaggctaatgtcggcagccgttaaggatgagagagccgtacacgccgacatgggctattggatagaaagccaaaagaatggtagttggaagctagaaaaggcatctctcatagaggtaaaaacctgcacatggccaaaatcacacactctctggagcaatggtgtgttggagagtgatatgatcatcccaaagagtctggctggtcctatctcgcaacacaattacaggcctggataccacacccaaacggcaggaccatggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacacttcctcccctgcgatatatgggagaagacggctgctggtatggcatggaaattagacccattaatgagaaagaagagaatatggtaaaatctttagtctcagcagggagtggaaaggtggataacttcacaatgggtgtcttgtgtcttgcaatcctctttgaagaggtaatgagaggaaaattcgggaaaaagcacatgattgcaggggttcttttcacatttgtgctccttctctcagggcaaataacatggagagacatggcgcgcacactcataatgattggatccaacgcctctgacagaatgggaatgggcgtcacttacctagcattgattgcaacatttaaaatccagccatttttggctttgggattctttctgaggaaactgacatctagagaaaatttattattaggagttgggttagccatggcaacaacgttgcaactgccagaggacattgaacaaatggcgaatggaatagccttggggctcatggctctcaaattgataacacaatttgaaacataccaactatgggcggcattagtctccctaatgtgttcaaacacaattttcacgttgactgttgcctggagaacagccaccctgatcttggccggaatttcgcttttgccaatgtgccagtcctcgagcatgaggaaaacagattggctcccaatgactgtggcagctatgggagttccacctctaccactttttattttcagtttgaaagacacactcaaaaggagaagctggccactgaatgagggggtgatggccgttggacttgtgagcattctagcaagctctctccttaggaatgacgtacccatggctggaccattagtggctgggggcctgctgatagcatgctacgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgctcttgaaaacagcattactaatagtgtcaggcatttttccatactccatacctgcaacacttctggtctggcacacttggcaaaagcaaacccaaagatccggcgtcctgtgggacgtacccagccccccagagacacagaaagcagaactggaagagggggtttataggatcaagcagcaaggaatttttggaaagacccaagtgggagttggagtacaaaaagaaggagttttccacaccatgtggcatgtcacaagaggagcagtgttgacacacaatggaaaaagactggaaccaaactgggctagcgtgaaaaaagatctgatttcatacggaggaggatggagactgagtgcacaatggcaaaaaggagaagaggtgcaggttattgccgtagagcctgggaagaacccaaaaaactttcaaaccatgccaggcattttccagacaacaacaggggagataggagcgattgcactggacttcaagcctggaacctcaggatctcccatcataaacagagagggaaaggtagtgggactatatggcaacggagtggttacaaagaatggtggctatgtcagtggaatagctcaaacaaacgcagaaccagacggaccgacaccagagctggaagaagagatgttcaaaaagcgaaatctaaccataatggatctccatcctgggtcaggaaagacgcggaaataccttccagctatagttagagaggcaatcaagagacgcttaaggactctaattttagcaccaacaagggtggttgcagctgagatggaagaagcattgaaggggctcccaataaggtatcaaacaactgcaacaaaatctgaacacacagggaaagagattgttgacctaatgtgtcacgcaacgttcacaatgcgtttactgtcaccagtcagagttccaaactacaacttgataataatggatgaggctcatttcacagatccagctagtatagcggctagagggtacatatcaactcgtgtaggaatgggagaggcagccgcaattttcatgacagccacacctcctggaacagctgaagcctttcctcagagcaacgctccaattcaagatgaagaaagagacataccagaacgctcatggaattcaggcaatgattggattaccgactttgccggaaagactgtgtggtttgtccccagcatcaaagctgggaatgacatagcaaactgcttgcggaaaaatggaaaaaaggtcattcaacttagtaggaaaacttttgacacagaatatcaaaagaccaaactaaatgattgggactttgtggtgacaacagacatttcagaaatgggagccaatttcaaagcagacagagtgatcgacccaagaagatgtctcaaaccagtcatcttgacagacggacccgagcgcgtgatcctggcgggaccaatgccagtcaccgtggcgagtgctgcgcaaaggagagggagagttggcaggaacccacaaaaagaaaatgaccaatacatattcacgggccagcctctcaacaatgatgaagaccacgctcactggacggaagcaaaaatgctgctagacaacatcaacacaccagaaggaatcataccagctctctttgaaccagaaagggagaagtcagccgccatagacggcgaataccgcctgaaaggtgagtccaggaagacctttgtagaactcatgaggaggggtgatctcccagtttggctagctcataaagtagcatcagaagggatcaaatacacagacagaaaatggtgttttgatggagagcgcaacaatcaaattttagaggagaacatggatgtggaaatctggacaaaggaaggagaaaagaaaaaattgaggcctaggtggcttgatgcccgcacttattcagatcccttagcgctcaaggaattcaaggactttgcggctggtagaaagtcgatcgcccttgatcttgtgacagaaataggaagagtgcctccacatttagctcacagaacgagaaacgctctggacaatctggtgatgttgcacacgtcagaatacggtgggagggcctacaggcatgcagtggaggaattaccagaaacaatggaaacactcttactcctgggactcatgatcctgttaacaggtggggtgatgcttttcttgatatcaggcaaaggggttggaaagacttcaataggactcatttgtgtagttgcttccagtggcatgttatggatggctgatatcccactccaatggatcgcgtcggccatagttctggagttttttatgatggtgctacttataccagaaccagaaaagcagagaactccccaagacaatcaactcgcatatgtcgtgataggcatacttacattggctgcaatagtagcagccaatgaaatgggattgttggaaaccacaaagagagatttggggatgtccaaagaaccaggtgttgtttcgccaaccagctatttggatgtggatctgcacccagcatcagcctggacattgtacgctgtggccacaacagtaataacaccaatgttgagacacaccatagagaattccacagcaaatgtgtccctggcagccatagccaaccaggcagtggtcctgatgggtctagacaaaggatggccgatatcgaaaatggacttaggcgtgccactattagcactgggttgctattcacaagtgaacccactgactctcacagcggcagtgctcctgctagtcacgcactacgctattataggcccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttaatgagaacatcatgggcattttgtgaagctctgaccctagccacaggaccaataacaacactctgggaaggatcacctgggaagttctggaacaccacgatagctgtttccatggcaaacatctttagagggagctatttagcaggagctgggcttgctttttccatcatgaaatcagttggaacaggaaagagaggaacagggtcacaaggtgaaactttgggagaaaagtggaaaaagaaattgaatcaattatcccggaaagagtttgacctctacaaaaaatccggaatcactgaagtggatagaacagaagccaaagaagggttaaaaagaggagaaataacacaccatgccgtatccagaggcagcgcaaaacttcaatggttcgtggagagaaacatggtcattcctgaaggaagagtcatagacttgggctgtggaagaggaggctggtcatattattgtgcagggttgaaaaaagttacagaagtgcgaggatacacaaaaggcggcccaggacatgaagaaccagtacctatgtctacatatggatggaacatagtcaagctgattagtggaaaggatgtgttttatcttccacctgaaaagtgtgacaccctactgtgtgacattggagaatcatcaccaagcccaacagtggaggagagcagaaccataagagtcttgaaaatggttgaaccatggctaaaaaataaccagttttgcattaaagtattgaacccttacatgccagctgtgattgagcacctagaaagactacaaaggaaacatggaggaatgcttgtgagaaatccactctcacgaaactccacgcacgaaatgtactggatatctaatggcacaggcaacatcgtctcttcagtcaacatgatatccagactgctactgaacagattcacaatgacatataggagacccaccatagagaaagatgtggatttgggagcggggacccgacatgtcaatgcggaaccagaaacacccaacatggatgtcattggggaaagaataagaaggattaaggaggagcatagttcaacatggcactatgatgatgaaaatccttataaaacgtgggcttaccatggatcttatgaagtcaaggccacaggctcagcctcctccatgataaatggagtcgtgaaactcctcacgaaaccatgggatgtggtgcccacggtgacacagatggcaatgacggacacgaccccttttggccagcaaagagtttttaaagagaaagtggacaccaggacacccaaacccatgccaggaacaagaaaggttatggagatcacagcggaatggctttggagaaccttgggaaggaacaaaagacccagattatgcacgagagaagagttcacaaaaaaggtcagaaccaacgcagctatgggcgccgtattcacagaggagaaccaatgggacagtgctagagctgccgttgaagatgaagaattctggaaactcgtggacagagaacgtgaactccacaaactgggcaagtgtggaagctgtgtttataacatgatgggcaagagagagaagaaacttggagagtttggcaaagcaaaaggcagtagagccatatggtacatgtggttgggagccaggtaccttgagttcgaggcactcggatttttaaatgaagaccattggttctcgcgtgaaaactcttacagtggagtagaaggggaaggactgcataagctgggatatatcttgagagatatttccaagatacccggaggagctatgtatgctgatgacacagcagggtgggacacaagaataacagaagatgacctgcacaatgaggaaaaaattacacagcaaatggaccctgaacacaggcagttagcaaacgctatatttaagctcacttaccaaaacaaagtggtcaaagttcaacgaccaactccaaaaggcacggtaatggacatcatatctaggaaagaccaaagaggcagtggacaggtgggaacctatggtctaaatacattcaccaacatggaagcccagttgatcagacagatggaaggagaaggtgtgttgtcgaagacagacctcgagaaccctcatctgctagagaagaaaatcacacaatggttggaaaccaaaggagtggagaggttaaaaagaatggccatcagtggagatgattgcgtggtgaaaccaatcgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtggtcccctgcagacctcaggacgaattaatagggagagcaagaatctctcagggagcaggatggagccttaaagaaactgcatgcttagggaaagcctacgcccaaatgtgggctctcatgtattttcacagaagagatcttagactagcatccaatgccatatgttcagcagtaccagtccattgggtccccacaagcagaacgacgtggtccatccatgctcaccatcagtggatgactacagaagacatgcttactgtttggaacagggtgtggatagaggacaatccatggatggaagacaaaactccagtcacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccttcgatgaagagattcaggaaggaggaggagtcagagggagccatttggtaa

SEQ ID NO: 7226 - RNA, 9873 nt, synthetic construct
  misc_feature 1..9873: note = derived and/or modified CDS sequence (wt) from DENV-3__JF808121__SS-prME
  source 1..9873: mol_type = other RNA
acatcgctctgcctcatgatgatattgccagcagcacttgctttccacttgacttcacgagatggagagccgcgcatgattgtggggaagaatgaaagaggaaaatccctactttttaagacagcctctggaaccaacatgtgcacactcatagccatggacttgggagagatgtgtgatgacacggtcacttacaaatgcccccacattaccgaagtggaacctgaagacattgactgttggtgcaaccttacatcaacatgggtgacttacggaacgtgcaatcaagccggagagcgtagacgcgacaagagatcagtggcgttggctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccaaaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcccacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaactaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtattttttcggggcatttaaaatgtagactcaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaactggagacaacgctttgaaaatcaactggtataagaaaggaagctctattgggaagatgttcgaggccactgccagaggtgcaaggcgcatggccatcttgggagacacagcttgggactttggatcagtgggtggtgttctgaactcattaggtaaaatggtgcaccaaatattcggaagtgcttacacagccctattcagtggagtctcttgggtaatgaaaatcggaataggagttctcttgacttggatagggttgaattcaaaaaacacatccatgtcattttcatgtattgcgataggaatcattacactctatctaggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttctttacgtttgtgctccttctctcagggcaaataacatggagagacatggcgcacacactaacaatgattgggtccaacgcatctgacaggatgggaatgggcgttacctacctagccttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggatagcattaatctccttaacgtgttcaaacacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatctttagcttgaaagacacactcaaaaggagaagctggccactgaatgaaggggtgatggctgttgggcttgtgagcattttggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggagtctttccatactccatacctgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacgggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagagcgctcatggaattcaggcaatgaatggataactgacttcgctgggaaaacggtgtggtttgtccccagcattaaagccggaaatgacatagcaaactgcttgcggaaaaacgggaaaaaggtcatccaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctactggacaacattaatacaccagaagggatcataccagctctctttgagccagaaagggagaagtcagctgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgctcttcttaatatcaggtaaagggattggaaagacttcaataggactcatttgtgtaattgcttccagtggcatgttgtggatggccgaaatcccactccaatggatcgcgtcggctatagtcctggagtttttcatgatggtgttgcttataccagaaccagaaaagcagagaaccccccaagacaaccaactcgcatatgtcgtgataggcatacttacattggctgcaataatagcagctaacgaaatgggattgttggaaactacaaaaagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagctgcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggcttgctttttctattatgaaatcagttggaacaggaaaaagaggaacaggctcacaaggtgaaactttaggagaaaaatggaaaaagaaattaaatcaattatcccggaaagagtttgatctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgaaacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggaaaaccctgggaaggaacaaaaaacccaggttatgcccaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaacccccatctgccagagaagaaaattacacaatggttggaaaccaaaggagtggagaggttaaaaaggatggccattagcggggatgattgcgtagtgaaaccaatcgatgacaggttcgctaatgccctgctcgctctgaacgatatgggaaaggttcggaaagacatacctcaatggcagccatcaaagggatggcatgactggcaacaggttcctttctgctcccaccactttcatgaattgatcatgaaagatggaagaaagttggtggttccctgcagaccccaggacgaactaataggaagagcaagaatctctcaaggatcgggatggagccttagagaaaccgcatgtctggggaaagcctacgctcaaatgtggagtctcatgtattttcacagaagagacctcagactagcatccaacgccatatgttcagctgtaccagtccactgggtccccacaagtagaatgacatggtctattcatgctcaccatcagtggatgaccacagaagacatgcttactgtctggaatagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7227 - RNA, 9873 nt, synthetic construct
  misc_feature 1..9873: note = derived and/or modified CDS sequence (wt) from DENV-3__JF808120__SS-prME
  source 1..9873: mol_type = other RNA
acatcgctctgcctcatgatgatattgccagcagcacttgctttccacttgacttcacgagatggagagccgcgcatgattgtggggaagaatgaaagagggaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttggctccccatgtcggcatgggactagacacacgcacccaaacctggatgtcggctgaaggagcctggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtgggaaacagagattttgtggaaggtctatcaggagctacgtgggttgacgtggtgctcgagcacggggggtgtgtgactaccatggctaagaacaagccaacgttggatatagagcttcagaagactgaggccacccaattggcgaccctaaggaagctatgcattgaggggaaaattaccaacataacaactgactcaagatgtcccacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaactaatagagggaaaagtggtgcagtatgagaacctcaaatacaccgtcatcatcactgtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcatttaaaatgtagacttaagatggacaaattggaactcaaagggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaactggagacaacgctttgaaaatcaactggtataagaaaggaagctctattgggaagatgttcgaggccactgccagaggtgcaaggcgcatggccatcttgggagacacagcttgggactttggatcagtgggtggtgttctgaactcattaggtaaaatggtgcaccaaatatttggaagtgcttacacagccctattcagtggagtctcttgggtaatgaaaatcggaataggagttctcttgacttggatagggttgaattcaaaaaacacatccatgtcattttcatgcattgcgataggaatcatcacactctatctaggagccgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttaaagcaaggaaaaagaacactaacaccacaacccatggagctgaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtctttacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttctttacgtttgtgctccttctctcagggcaaataacatggagagacatggcgcacacactaataatgattgggtccaacgcatctgacaggatgggaatgggcgttacctacctagccttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatctttaacttgaaagacacactcaaaaggagaagctggccactgaatgaaggggtgatggctgttgggcttgtgagcattttggccagttctctccttagaaatgatgtacccatggctggaccattggtggccgggggcttgctaatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaattcttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcagaagggggaggaggtgcaggttattgccgtagagcctgggaagaacccaaagaactttcaaaccatgccaggcacttttcagactacaacgggggaaataggagcaattgcactggatttcaagcctggaacttcaggatctcccatcataaatagagagggaaaggtagtgggactgtatggcaatggagtggttacaaagaatggtggctacgtcagcggaatagcgcaaacgaatgcagaaccagatggaccgacaccagaactggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattattgacctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagagcgctcatggaattcaggcaatgaatggataaccgacttcgctgggaaaacggtgtggtttgtccccagcattaaagccggaaatgacatagcaaactgcttgcgaaaaaacggaaaaaaggtcatccaacttagcaggaagacttttgacacagaatatcagaaaaccaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcactgcggcgagtgctgcgcaaaggagagggagagttggcaggaacccacaaaaagaaaatgaccagtacatattcacgggccagcctctcaataatgatgaagaccatgctcactggacagaagcaaaaatgctgctggacaacattaatacaccagaagggatcataccagctctctttgagccagaaagggagaagtcagctgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacctattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacatcagaacatggcggtagggcctacaggcatgcggtggaggaactaccagagacaatggaaacactcctactcttgggactcatgatcttgttgacaggtggagcaatgctcttcttaatatcaggtaaagggattggaaagacttcaataggactcatttgcgtaattgcttccagtggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaacgaaatgggattgttggaaactacaaaaagagatttaggaatgtctaaggagccaggcgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtagtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacagtggatgggataatgacaatagacctagatcccgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggacagaacagaagccaaagaagggttgaaaagaggagaaataacacatcatgccgtgtccagaggtagcgcaaaacttcaatggttcgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgaccacatatggatggaacatagttaagttaatgagtggaaaggatgtgttttatcttccacctgaaaagtgtgacaccctgttgtgtgacattggagaatcttcaccaagcccaacggtggaagaaagcagaactataagagtcttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagccgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttaggagccaggtaccttgagttcgaagcccttggattcttaaatgaagaccactggttctcgcgtgagaactcttacagtggagtggaaggagaaggactgcacaagctaggctatatactaagggacatttccaagatacccggaggagctatgtatgcagatgacacagctggttgggacacaagaataacagaagatgacctgcacaatgaggaaaagatcacacagcaaatggaccctgaacacaggcagttagcgaacgctatttttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaacccccatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgactggcaacaggttcctttctgctcccaccactttcatgaattgatcatgaaagatggaagaaagttggtggttccctgcagaccccaggacgaactaataggaagagcaagaatctctcaaggatcgggatggagccttagagaaaccgcatgtctggggaaagcctacgctcaaatgtggagtctcatgtattttcacagaagagacctcagactagcatccaacgccatatgttcagctgtaccagtccactgggtccccacaagtagaacgacatggtctattcatgctcaccatcagtggatgaccacagaagacatgctcactgtctggaatagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7228 - RNA, 9873 nt, synthetic construct
  misc_feature 1..9873: note = derived and/or modified CDS sequence (wt) from DENV-3__JF808119__SS-prME
  source 1..9873: mol_type = other RNA
acatcgctctgtctcatgatgatattgccaacagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggctcttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcccacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagcccacaatggcagactgattacagccaacccagtggtgactaagaaggacgagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccattttgggagacacagcctgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacttgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaaccacaacagtgtcagggaagttaatacacgaatggtgttgccgttcgtgtacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcatgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgaacaaacaggagtgtcccacaacttaatgatcacagttgatgatgatggaacaatgaggataaaagatgatgagactgagaatatcctaacagtacttttgaaaacagcattactaatagtgtcaggagtctttccatactccatacccgcaacattgctggtctggcatacttggcaaaagcaaacccaaagatccggcgttctatgggacgtgcccagccccccagagacacagaaagcagaactggaagaaggggtctataggatcaagcagcaaggaatttttgggaaaacccaagtaggggttggagtacagaaagaaggagtcttccacaccatgtggcacgtcacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgttagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattttggcaccgacaagggtggttgcagctgagatggaagaagcattgaaaggcctcccaataaggtaccaaacaacagcaacaaaatctgaacacacaggaagagagattgttgatctaatgtgccacgcaacgttcacaatgcgtttgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaagactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtaccgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggggcaatgcttttcttaatatcaggtaaagggattggaaagacctcaataggactcatttgtgtgattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtgcccctactggcattgggttgctattcacaagtgaacccactgactctaacagcggcagtactcttgctgatcacacattatgctattataggtccaggattgcaggcaaaagccactcgcgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatctttagagggagctatttagcaggagctgggcttgctttttctattatgaaatcagttggaacaggaaaaagaggaacaggctcacaaggtgaaactttaggagaaaaatggaaaaagaaattaaatcaactatcccggaaagagtttgacctttacaagaaatctggaatcactgaagtggatagaacagaagccaaagaagggttgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacataattaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaaatattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaaaaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggagaccaaaggagtggagaggttaaaaagaatggccattagcggggaagattgcgtattgaaaccaattgatgacaggttcgataatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagcagaacgacatggtctattcatgctctccatcagtggatgaccacagaagacatgattactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7229 - RNA, 9873 nt, synthetic construct
  misc_feature 1..9873: note = derived and/or modified CDS sequence (wt) from DENV-3__JF808118__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaacctcacatcaacatgggtgacttacggaacgtgcaatcaagccggagagcgtagacgcgacaagagatcagtggcgttagctccccatgtcggcatgggactagacacacgcactcaaacctggatgtcggctgaaggagcttggaggcaagtcgagaaggtagagacatgggcccttaggcacccagggttcaccatactagccctatttcttgctcattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgatcctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcatactgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctctacagaggatggacaagggaaagctcacaatggcagactgattacagccaacccagtggtgactaagaaggaggagcctgtcaatattgaggctgaacctccttttggggaaagtaatatagtgattggaattggagacaacgccttaaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtagtgcaagctgacatgggatgtgttataaactggaaaggcaaagaactcaaatgtggaagtggaatcttcgtcaccaacgaggtccatacctggacagagcaatacaaattccaagcagactccccgaaaagattggcgacagccattgcaggcgcttgggagaatggagtgtgcggaattaggtcaacaaccagaatggagaatctcctgtggaagcaaatagccaatgaattgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggccggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccattagtgagaaagaagagaacatggtaaagtctttagtctcagcgggaagtggaaaggtggacaacttcacaatgggtgtcttgtgtttggcaattctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctagggctcatggctcttaaattgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccaccactaccactctttatttttagcttgaaagacacacttaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtctaggaagaccttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaagaattcaaggactttgcggctggcagaaagtcaatcgcccttgaccttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcctgggactcatgatcttgttgacaggtggagcaatgcttttcttaatatctggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtctctccaaccagctatttagatgtggacttgcacccagcatcagcctggacattgtatgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacggcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggtcatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggacagaacagaagccaaagaagggttgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctggaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggtcagcagagagtctttaaagagaaagtggacaccaggacacccaggtccatgccaggaacaagaagggtcatggggatcacagcggagtggctctggagaaccttgggaaggaacaaaaaacccaggttatgcacaagggaagagtttacaaaaaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggtagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccatcagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagacctcaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacttgggaaaatgtcccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7230 - RNA, 9873 nt, synthetic construct
  misc_feature 1..9873: note = derived and/or modified CDS sequence (wt) from DENV-3__JF808127__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccctgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatacggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcacaagagggagcaatgcataccgcattgacaggagccacagaaatccaaaactcaggaggcacaagtatttttgcggggcatttaaaatgtagacttaagatggacaaattggaacttaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggaacctgtcaatattgaggctgaacctccttttggggaaagtaatatagtgattggaactggagacaacgctttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctgaaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggataatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcttgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacagtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgaccttaacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaagggagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaaaatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaagttatgcacaagggaagagttcacaaaaaaggtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7231 - RNA, 9873 nt, synthetic construct
  misc_feature 1..9873: note = derived and/or modified CDS sequence (wt) from DENV-3__JF808124__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacagtcacttacaaatgcccccacattactgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacctttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagcccacaatggcagactgattacagccaacccagtggtgactaagaaggaggagcttgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaattattacactctacctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatgggagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcctgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgtacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttgttcacgtgtgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatgggaaatggaatcgctctggggctcatggctcttaaactgataacacaatttgaaacataccaattatggacagcattgatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgacggaacaatgagaataaaagatgatgagactgagaatatcctaacagtgcttttgaaaacagcattactaatactatcaggagtctttccatactccatacccgcaacgttgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtataggggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaatgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcatatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgtcgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctccccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggtggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacatcgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaagccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagctcttggattcttaaatgaagaccactggttctcacgtgagaactcttacagtggagtggaaggagaaggactgcacaagctaggctatatattaagggacatctccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaatgatatgggaaaggttcggaaagacatacctcaatggcagccatcaaagggatggcatgactggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagaccttagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7232 - RNA, 9873 nt, synthetic construct
  misc_feature 1..9873: note = derived and/or modified CDS sequence (wt) from DENV-3__JF808126__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaagtgcccccacatcaccgaagtggaacctgaagacattgactgctggtgcaaccttacatcaacatgggtgacttacggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttacactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggtttcttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatatttggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaagtcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacagcgggaccctggcatttaggaaaattagagctggacttcaactattgtgaaggaacaacagttgtcatcacagaaaactgtgggacaagaggcccagcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctgcccactgaatgaaggggtgatggctgttgggcttgtgagcattctagccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctggtttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtccaaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacagtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatatttacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaagatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactcccatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaagatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7233 - RNA, 9873 nt, synthetic construct
  misc_feature 1..9873: note = derived and/or modified CDS sequence (wt) from DENV-3__JF808125__SS-prME
  source 1..9873: mol_type = other RNA
acatcgctctgtctcatgatgatattgccagcagcacttgctttccacttgacttcacgagatggagagccgcgcatgattgtgggggagaatgaaagaggaaaatccctactttttaagacagcctctggaatcaacaggagaacgctcatagccatggacttgggagagatgtgtgaagaaacggaaacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcacacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacagcggaaacaccaacctggaacaggaaggagcttcttgtgacatttaaaaacgcacatgcgaagaaacaagaagtagtcgtccttggatcgcaagagggagcaatgcataccgcattgacaggagccacagaaatccaaaactcaggaggcacaagtatttttgcggggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcttcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggaggacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcttccggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggataatctggtgatgctgcacacgtcagaacatggcggtagggcctacaggcatgcggtggaggaactaccagagacaatggaaacactcctactcttgagactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcttgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacagtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaagggagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagatatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7234 - RNA, 9873 nt, synthetic construct
  misc_feature 1..9873: note = derived and/or modified CDS sequence (wt) from DENV-3__JF808129__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaataggaaggagcttcttgtgacatttaaaaacgcacatgcgaagaaacaagaagtggttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataactggggtcttagagcaaggaaaaagaacactaacaccacaacctatggagctgaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaactagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactgcacaatgggtgtcttgtgtttggcaatcctctttgaagacgtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgaccacagtcgatgatgatggaacaatgagaataaaagatgatgagactgagaatatcctaacagtgcttttgaagacagcattaacaatagtatcaggagtctttccatactccatacccgcaacattgctggtctggcatacttggcaaaagcaaacccaaagatccggcgttctatgggacgtacccagccccccagagacacagaaagcagagcaggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaacttataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaatgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgcttcgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaatatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggactaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatattcaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7235 - RNA, 9873 nt, synthetic construct
  misc_feature 1..9873: note = derived and/or modified CDS sequence (wt) from DENV-3__JF808123__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccacttggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctgggaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcatttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggtagactgattacagccaacccagtggtgaccaagaaggaggagcctgtcaatattgaggctgaacctccttttggggaaagtaatatagtgattggaactggagacaacgctttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaagtactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtgggaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacgtttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgaccgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcggcagacctcaccgtagaaaaagcagcagatataacatgggaggaagaggctgagcaaacaggagtgtcccacaacttaatgatcacagttgatgatgatggaacaatgagaataaaagatgatgagaccgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagacctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatccagggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagaaattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccacgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgcttcgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcctccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacctaggagtacccctactggcattgggttgctattcacaagtgaacccactgactctaacagcggcagtactcttgctgatcacacattacgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgcgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattccagaaggaagagtcatagacttgggctgtggaagaggaggctggtcatattactgtgcaggactgaaaaaagtcacagaagtgcgaggatacacaaaaggcggtccaggacacgaagaaccagtacccatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtag

SEQ ID NO: 7236 - RNA, 9873 nt, synthetic construct
  misc_feature 1..9873: note = derived and/or modified CDS sequence (wt) from DENV-3__JF808128__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaagtgcccccacatcaccgaagtggaacctgaagacattgactgctggtgcaaccttacatcaacatgggtgacttacggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaggaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcaaggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggtttcttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatatttggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactatatattgtgggaaaacaatatcaaattaacggtagttgtgggcgatataattggggtcttagagcaaggaaaaagaacactaacaccacaacccatggagctaaaatactcatggaaaacgtggggaaagtcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacagcgggaccctggcatttaggaaaattagagctggacttcaactattgtgaaggaacaacagttgtcatcacagaaaactgtgggacaagaggcccagcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctagccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctggtttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacagtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatatttacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaagatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttcccgcagcatgtcgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcggctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaagatgaggatttttggaaacttgtggacagagaacgtgaactccacaaactgggcaagtgtggaagctgcgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7237 - RNA, 9873 nt, synthetic construct
  misc_feature 1..9873: note = derived and/or modified CDS sequence (wt) from DENV-3__JF808122__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcatcaagtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttggctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccccccacttggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcatttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggtagactgattacagccaacccagtggtgaccaagaaggaggagcctgtcaatattgaggctgaacctccttttggggaaagtaatatagtgattggaactggagacaacgctttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctttccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaaggactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggatttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagtggcatgtcgtggatggccgaaatcccactccaatggatcgcgtcggctatagtcttggagttttttatgatggtgttgcttataccagaaccagaaaagcagagaaccccccaagacaatcaactcgcatatgtcgtgataggcatacttacattggctgcaataatagcagctaatgaaatgggattgttggaaactacaaaaagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaacgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcatccccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtttttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaacggaagtagagctatatggtacatgtggttgggagccaggtaccttgagttcgaagcccttggattcttaaaggaataccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgactgcgtagtgaaaccaatcgatgacaggtttgctaatgccctgctcgctctgaacgatacgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7238 - RNA, 9873 nt, synthetic construct
  misc_feature 1..9873: note = derived and/or modified CDS sequence (wt) from DENV-3__GQ466079__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaggtggaacctgaagacattgactgctggtgcaaccttacatcaacatgggtgacttatggaacgtgcaatcaagctggagagcatagacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagccctatttcttgcccattacataggcacctccttgacccagaaggtggttatttttatactactaatgctggtcaccccatccatgacaatgagatgtgtgggagtgggaaacagagattttgtggaaggtctgtcaggagctacgtgggttgacgtggtgctagagcacggggggtgtgtgaccaccatggctaagaacaagcccacgctggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggttgtggtttgtttggcaagggaagcttggtaacatgtgcgaaatttcaatgcctggaaccgatagagggaaaagtggtgcaatatgagaacctcaaatacaccgtcatcattacagtgcacacaggagaccaacaccaggtgggaaatgaaacgcagggagtcacggctgagataacgcctcaggcatcaactactgaagccatcttgcctgaatatggaacccttgggctagaatgctcaccacggacaggtttggacttcaatgaaatgatcttactaacaatgaagaacaaagcatggatggtacacagacaatggttttttgacctacctctaccatggacatcaggagctacaacagaaacaccaacttggaacaggaaggagctccttgtgacattcaaaaatgcacatgcgaaaaaacaagaagtagttgtccttggatcgcaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgatcacagccaacccagtggtgactaagaaggaggagcctgttaacattgaggctgaacctccttttggggaaagtaatatagtaattggaattggagacaatgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtgatgaaaattggaataggtgttctcttgacttggatagggttgaattcaaaaaacacatccatgtcattttcatgcattgcgataggaatcatcacactctatctgggagctgtggtgcaagctgacatggggtgtgtcataaactggaaaggcaaagaacttaaatgcggaagtggaattttcgtcaccaacgaggtccatacctggacagagcagtacaaattccaagcagactccccaaaaagattggcgacagccattgcaggcgcttgggagaatggagtgtgtgggattaggtcaacaaccagaatggagaacctcttgtggaagcaaatagccaatgaactgaactacatattatgggaaaacaatatcaaactaacagtagttgtgggcgatacaattggggtcttagagcaagggaagagaacactaacaccacaacccatggagctaaaatactcatggaaaacgtggggaaaggcaaaaatagtgacagctgaaacacaaaactccttttttataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctactggatagaaagccaaaagaatggaagttggaagctagaaaaagcatccctcatagaggtaaaaacctgcacatggccaaaatcacacactctctggagcaacggtgtgctagagagtgacatgatcattccaaagagtctagctggtcccatttcgcaacacaaccacaggcccgggtaccacacccaaacggcaggaccctggcacttagaaaatttggagctggacttcacctattgtgaaggaacaacagttgtcatcacagaaaactgtgggacaagaggcccatcattgagaacgacaacagtatcaggaaagttgatacacgaatggtgttgccgctcgtgcacacttcctcctctgcgatacatgggagaagacggctgttggtatggcatggaaatcagacccatcagtgagaaagaagagaacatggtaaagtctttagtctcagcgggaagtggaaaggtagacaacttcacaatgggtatcttgtgcttggcaatcctctttgaagaggtgatgagaggaaaatttgggaagaaacacatgattgcaggggttttcttcacgtttgtgctccttctctcagggcaaataacatggagagacatggcgcacacactaataatgattgggtccaacgcctctgacaggatgggaatgggcgtcacctatctagctttgattgcaacatttaaaatccagccattcctggctttgggatttttcctaagaaaactgacatctagagaaaatttactgttaggagttggactggctatggcaacaacgttacaactgccagaggacattgaacaaatggcaaatggaatcgccctggggctcatggctcttaaattgataacacaatttgaaacataccaattatggacggcattaatctccttaacgtgttcaaatacaattttcacgttgactgttgcctggagaacagccaccctgattttggccggagtttcacttttaccagtgtgccagtcttcgagcatgaggaaaacagactggcttccaatgacagtggcagctatgggagtcccacccctaccactctttatttttagcttgaaagacacactcaaaaggagaagctggccactgaatgaaggggtgatggctgttgggcttgtgagcattcttgccagttctctccttagaaatgacgtacccatggctggaccattagtggccgggggcttgctgatagcgtgctacgtcataactggcacgtcagcagaccttacagtagaaaaagcagcagatgtaacatgggaggaagaggctgagcaaacaggagtgtcccacaacttaatgatcacagttgatgatgatggaacaatgagaataaaagatgatgagactgagaatattctaacagtgcttttgaagacagcattactaatagtatcaggtatttttccatactccatacccgcaacattgttggtctggcatacttggcaaaagcaaacccaaagatccggtgttctatgggacgtacccagccccccagagacacagaaagcagaactggaagaaggggtctataggatcaaacagcaaggaattcttgggaaaacccaagtaggggttggagtacaaaaagaaggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcccgggaagaacccaaagaactttcaaaccatgccaggcacatttcagactacaacaggggaaataggagcaattgcactggatttcaagcctggaacttcagggtctcctatcataaacagagagggaaaggtagtgggactatatggcaatggagtggttacaaagaatggcggctacgtcagcggaatagcgcaaacaaatgcagaaccagatggaccgacgccagagttggaagaagagatgttcaaaaagcgaaatctaaccataatggatcttcatcctgggtcaggaaagacacggaaataccttccagccattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaattataacttgataataatggatgaggcccatttcacagacccagccagtatagcggccagagggtacatatcaactcgtgttggaatgggagaggcagccgcaattttcatgagtgcaacgccccctggaacagctgatgcctttcctcagagcaatgctccaattcaagatgaagaaagggacataccagaacgctcatggaattcaggcaatgaatggattaccgacttcgccgggaaaacggtgtggtttgtccccagcatcaaagccggaaatgacatagcaaactgcttgcgaaagaacgggaaaaaggtcattcaacttagtaggaagacttttgatacagaatatcagaagactaaactaaatgattgggactttgtggtgacaactgacatttcagaaatgggggccaatttcaaagcagatagagtgatcgacccaagaagatgtctaaaaccagtgatcctgacagatggaccagagcgggtgatcttggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgttgctggacaacatcaacactccagaaggaatcataccagctctctttgaaccagaaagggagaagtcagccgccatagacggtgaatatcgcctgaagggtgaatccaggaagactttcgtggaactcatgaggaggggtgaccttccagtttggttagcccacaaagtagcatcagaagggatcaaatatacagataggaaatggtgctttgatggacagcgcaacaatcaaattttagaggaaaacatggacgtggaaatctggacaaaggaaggagaaaagaaaaaattgagacctaggtggcttgatgcccgcacttattcagatcccttagcactcaaggaattcaaggactttgcggctggcagaaagtcaattgcccttgatcttgtgacagaaataggaagagtgccttcacacctagcccacagaacgagaaacgctctggacaatctggtgatgctgcacacgtcagaacatggcggtagggcctacaggcatgcggtggaggaactaccagaaacaatggaaacactcctactcttgggactcatgatcttactgacaggtggagcaatgcttttcttgatatcaggtaaagggattggaaagacttcaataggactcatttgtgtgattgcttccagcggcatgctgtggatggccgaaatcccactccaatggatcgcgtcggctatagtcctggagttttttatgatggtgttgcttataccagaaccagaaaagcagagaaccccccaagacaaccaactcgcatatgtcgtaataggcatacttacattggctgcaataatagcggccaatgaaatgggactgttggaaactacaaagagagatttaggaatgtctaaggagcccggtgttgtttctccaactagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactactggcattgggttgctattcacaagtgaacccactgactctaacagcggcagtacttttgctaattacacattatgctattataggtccaggactgcaggcaaaagccactcgtgaagctcaaaaaaggacagctgctggaataatgaagaatccaacggtggatgggataataacgatagacctagatcctgtaatatacgattcaaaatttgaaaagcaactgggacaggtcatgctcctggttttgtgtgcagttcaactgttgttaatgagaacatcatgggccttgtgtgaagctttaactttagctacaggaccaataacaacactctgggaaggatcacctgggaagttttggaataccacgatagctgtttccatggcgaacatttttagagggagctatttagcaggagctgggcttgccttttctattatgaaatcagttggaacaggaaaaagaggaacaggctctcaaggtgaaactttaggagaaaaatggaaaaagaaattgaatcaattatcccggaaagagtttgacctttacaagaagtctggaatcactgaagtggatagaacagaagccaaagaagggttgaaaagaggagaaacaacacatcatgccgtgtctagaggtagtgcaaaacttcaatggttagtggagagaaacatggtcattcccgaaggaagagtcatagacctgggctgtggaagaggaggctggtcatattactgtgcaggactgaaaaaagtcacagaagtgcgaggatacacaaaaggcggtccaggacacgaagaaccagtgcctatgtcaacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctgaaaaacaaccagttttgcattaaagtattgaacccttacatgccagccgtgattgagcacctagaaagactacaaaggaaacacggaggaatgcttgtgagaaatccactttcacgaaactccacgcacgaaatgtactggatatctaatggtacaggtaacattgtctcttcagtcaacatggtatccagattgttactgaacaggttcacgatgacacacaggagacctaccatagagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccacggatcttatgaagtcaaagccacaggctcagcctcctccatgataaatggagtcgtgaaacttctcactaaaccatgggatgtggtgcccatggtgacacagatggcaatgacagatacaactccatttggccagcagagagtctttaaagagaaagtggacaccaggacacccaggcctatgccagggacaagaaaggttatggagatcacagcggagtggctctggagaaccctgggaaggaacaaaagacccaggttatgcacaagggaagagtttacaaaaaaggtcagaaccaacgcagccatgggcgccgttttcacagaggagaaccaatgggacagtgcgaaagctgctgttgaggatgaagagttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggatccaggtaccttgagttcgaagcccttggattcttaaatgaagaccactggttctcgcgtgaaaactcttacagtggagtagaaggagaaggactgcacaagctaggctacatattaagggatatctccaagatacccggaggagccatgtatgctgatgacacagctggttgggacacaagaataacagaagatgacctgcacaatgaggaaaagatcacacagcaaatggaccctgaacacaggctgttagcgaacgctatattcaagctcacataccaaaacaaagtggtcaaagttcaacgaccgactccaacgggcacggtaatggacatcatatctaggaaagaccaaaggggcagtggacaggtgggaacttatggtctgaatacatttaccaacatggaagcccagttagtcagacaaatggaaggagaaggtgtgctgtcaaaggcagacctcgagaaccctcatctgccagaaaagaaaattacacaatggttggaaaccaaaggagtggagaggttaaaaagaatggccattagcggggatgattgcgtagtgaaaccaattgatgacaggttcgctaacgccctgcttgctctgaacgatatgggaaaggttcggaaagacatacctcaatggcagccatcaaagggatggcatgactggcagcaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtttggggaaagcctacgcccaaatgtggagtctcatgtattttcacagaagagatctcagactagcgtccaatgccatatgttcagcagtaccagtccactgggtccccacaagtagaacgacatggtctattcatgctcaccatcagtggatgaccacagaagacatgcttactgtttggaacagggtgtggatcgaggacaatccatggatggaagacaaaactccagttacaacctgggaaaatgttccatacctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagattcaggaaggaggaggagtcggagggagccatttggtaa

SEQ ID NO: 7239 - RNA, 9873 nt, synthetic construct
  misc_feature 1..9873: note = derived and/or modified CDS sequence (wt) from DENV-3__FJ898462__SS-prME
  source 1..9873: mol_type = other RNA
acatcgctctgtctcatgatgatattgccagcagcacttgctttccacttgacttcacgagacggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggtcttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctctacagaggatggacaagggaaagcccacaatggcagattgattacagccaacccagtggtgactaagaaggaggagcctgtcaatattgaggctgaacctccttttggggaaagtaatatagtgattggaattggagacaacgccttaaaaatcaactggtacaagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacctatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaattgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactctttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagcgtgaaaaaagatctgatttcatacggaggaggatggagattgagcgcacaatggcaaaggggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtctaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgaccttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtagatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggacagaacagaagccaaagaagggttgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaatagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggttatgcacaagggaagagtttacaaaaaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggtagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacagtaatggacatcatatctaggaaagaccaaagaggcagtggacaggtaggaacttatggactgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7240 - RNA, 9873 nt, synthetic construct
  misc_feature 1..9873: note = derived and/or modified CDS sequence (wt) from DENV-3__KF955473__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgatcctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcatactgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctctacagaggatggacaagggaaagctcacaatggcagactgattacagccaacccagtggtgactaagaaggaggagcctgtcaatattgaggctgaacctccttttggggaaagtaatatagtgattggaattggagacaacgccttaaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtagtgcaagctgacatgggatgtgttataaactggaaaggcaaagaactcaaatgtggaagtggaatcttcgtcaccaacgaggtccatacctggacagagcaatacaaattccaagcagactccccgaaaagattggcgacagccattgcaggcgcttgggagaatggagtgtgcggaattaggtcaacaaccagaatggagaatctcctgtggaagcaaatagccaatgaattgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggccggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccattagtgagaaagaagagaacatggtaaagtctttagtctcagcgggaagtggaaaggtggacaacttcacaatgggtgtcttgtgtttggcaattctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctagggctcatggctcttaaattgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccaccactaccactctttatttttagcttgaaagacacacttaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtctaggaagaccttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaagaattcaaggactttgcggctggcagaaagtcaatcgcccttgaccttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcctgggactcatgatcttgttgacaggtggagcaatgcttttcttaatatctggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtctctccaaccagctatttagatgtggacttgcacccagcatcagcctggacattgtatgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacggcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggtcatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggacagaacagaagccaaagaagggttgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggtcagcagagagtctttaaagagaaagtggacaccaggacacccaggtccatgccaggaacaagaagggtcatggggatcacagcggagtggctctggagaaccttgggaaggaacaaaaaacccaggttatgcacaagggaagagtttacaaaaaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggtagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagacctcaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacttgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7241 - RNA, 9873 nt, synthetic construct
  misc_feature 1..9873: note = derived and/or modified CDS sequence (wt) from DENV-3__FJ850079__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagccacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacttggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatgttgaggctgaacctccttttggggaaagtaatatagtaattggaattggagacaacgccttgaaaatcaactggtacaagaagggaagctccattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctatttagtggagtctcttgggtaatgaaaattggaataggagttctcttgacttggatagggttgaattcaaaaaacacatccatgtcattttcatgcattgcaataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataactggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccttggcatttaggaaaattagagctggactttaactattgcgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccaaccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagttggccactgaatgaaggggtgatggctgttgggcttgtgagcattctggccagttctcttcttagaaatgatgtacccatggctggaccattagtggccgggggcttgctgatagcgtgctacgttataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttggaaaaacccaagtaggggttggagtacagaaagaaggagtctttcacaccatgtggcacgttacaagaggggcagtattgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggagataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatttaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgactttgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaacaatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacacttctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaacccctcaagacaaccaactcgcatatgtcgtgataggcatacttacattggcagcaataatagcagccaatgaaatgggattgttggaaactacaaagagagatttaggaatgtctaaggagccaggtgttgtttctccaaccagttatttagatgtggacttgcacccagcatcagcctggacattgtacgctgtggccaccacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagaccccgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagatttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacgcccaacatggatgtcattggggaaagaataaaaaggatcaaggaggagcatgattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacgcagatggcaatgacagatacaactccatttggccagcagagagtctttaaagagaaagtggacaccaggacgcccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacatttaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7242 - RNA, 9873 nt, synthetic construct
  misc_feature 1..9873: note = derived and/or modified CDS sequence (wt) from DENV-3__FJ850080__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggctcttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcccacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaagagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacacagcatgggacaatactcattaaggtcgagtacaaaggggaagatgcaccttgcaagattcctttctccacagaggatggacaagggaaagcccacaatggcagactgattacagccaacccagtggtgactaagaaggacgagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccattttgggagacacagcctgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaatacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacttgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgtacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcatgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgaacaaacaggagtgtcccacaacttaatgatcacagttgatgatgatggaacaatgagaataaaagatgatgagactgagaatatcctaacagtacttttgaaaacagcattactaatagtgtcaggagtctttccatactccatacccgcaacattgctggtctggcatacttggcaaaagcaaacccaaagatccggcgttctatgggacgtgcccagccccccagagacacagaaagcagaactggaagaaggggtctataggatcaagcagcaaggaatttttgggaaaacccaagtaggggttggagtacagaaagaaggagtcttccacaccatgtggcacgtcacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctggaaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgttagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattttggcaccgacaagggtggttgcagctgagatggaagaagcattgaaaggcctcccaataaggtaccaaacaacagcaacaaaatctgaacacacaggaagagagattgttgatctaatgtgccacgcaacgttcacaatgcgtttgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaagactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtaccgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggggcaatgcttttcttaatatcaggtaaagggattggaaagacctcaataggactcatttgtgtgattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgcgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatctttagagggagctatttagcaggagctgggcttgctttttctattatgaaatcagttggaacaggaaaaagaggaacaggctcacaaggtgaaactttaggagaaaaatggaaaaagaaattaaatcaactatcccggaaagagtttgacctttacaagaaatctggaatcactgaagtggatagaacagaagccaaagaagggttgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacataattaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaaatattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaaaaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggagaccaaaggagtggagaggttaaaaagaatggccattagcggggatgattgcgtagtgaaaccaattgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgcccaaatgtggagtctcatgtattttcacagaagagacctcagactagcatccaacgccatatgttcagcagtaccagtccactgggtccccacaagcagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcagagggagccatttggtaa

SEQ ID NO: 7243 - RNA, 9873 nt, synthetic construct
  misc_feature 1..9873: note = derived and/or modified CDS sequence (wt) from DENV-3__FJ850083__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcatagacgcgacaagagatcagtggcgttagctccccatgtcggcatgggactagatacacgcacccaaacctggatgtcggctgaaggagcttggaggcaagtcgagaaggtagagacatgggcccttaggcatccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggagggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaacatgagaacctcaaatacaccgtcatcatcacagtgcacacaggagatcaacaccaggtgggaaacgaaacgcagggagtcacggctgagataacacctcaggcatcaaccactgaagccatcttgcctgaatatggaactcttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagagagaagtctcagaaacgcagcatgggacaatactcattaaggtcgagtacaaaggggaagatgcaccttgcaagattcctttctccacagaggatggacaagggaaagcccacaatggcagactgattacagccaacccagtggtgactaagaaggacgagcctgtcaatattgaggctgaacctccttttggggaaagtaatatagtgattggaattggagacaacgccttgaaaatcaactggtataagaaaggaagctctattgggaagatgttcgaggccaccgccagaggtgcaaggcgcatggccatcttgggagacacagcctgggactttggatcagtgggtggtgttctgaattcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaaccattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacttgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattggagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgaacaaacaggagtgtcccacaacttaatgatcacagttgatgatgatggaacaatgagaataaaagatgatgagactgagaatatcctaacagtacttttgaaaacagcattactaatagtgtcaggagtctttccatactccatacccgcaacattgctggtctggcatacttggcaaaagcaaacccaaagatccggcgttctatgggacgtgcccagccccccagagacacagaaagcagaactggaagaaggggtctataggatcaagcagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgttagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattttggcaccgacaagggtggttgcagctgagatggaagaagcattgaaaggcctcccaataaggtaccaaacaacagcaacaaaatctgaacacacaggaagagagattgttgatctaatgtgccacgcaacgttcacaatgcgtttgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaagactaaactgaatgattgggacttcgtggttacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctactggacaacattaatacaccagaagggatcataccagctctctttgagccagaaagggagaagtcagccgccatagacggtgagtaccgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcacttaaggaattcaaggactttgcggctggcagaaagtcaattgcccttgatcttgtgacagaaataggaagagtaccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggggcaatgcttttcttaatatcaggtaaagggattggaaagacctcaataggactcatttgtgtgattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagctactcgcgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatctttagagggagctatttagcaggagcagggcttgctttttctattatgaaatcagttggaacaggaaaaagaggaacaggctcacaaggtgaaactttaggagaaaaatggaaaaagaaattaaatcaactatcccggaaagagtttgacctttacaagaaatctggaatcactgaagtggatagaacagaagccaaagaagggttgaaaagaggagaaacaacacatcacgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccaccagaaaagtgtgacaccctgttgtgtgacattggagaatcttcaccaagcccaacagtggaagaaagcagaactataagagttttgaagatggttgaaccatggctaaagaacaaccaattttgcattaaaatattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaactctgggaaggaacaaaaaacccaggttatgcacaagggaagagtttacaaaaaaggtcagaactaacgcagccatgggcgccgttttcacagaggagaaccaatgggacagcgcgaaagccgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggagaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttataggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7244 - RNA, 9873 nt, synthetic construct
  misc_feature 1..9873: note = derived and/or modified CDS sequence (wt) from DENV-3__FJ850086__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggctcttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcccacccaaggggaagcggttttgcctgaggagcaggaccagaactacgtgtgtaagcacacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggttagaatgctcaccacgggcaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacacagcatgggacaatactcattaaggtcgagtacaaaggggaagatgcaccttgcaagattcctttctccacagaggatggacaagggaaagcccacaatggcagactgattacagccaacccagtggtgactaagaaggacgagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccattttgggagacacagcctgggactttggatcagtgggtggtgttctgaactcattaggcaaaacggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacttgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgtacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcatgtttgtgctccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgaacaaacaggagtgtcccacaacttaatgatcacagttgatgatgatggaacaatgagaataaaagatgatgagactgagaatatcctaacagtacttttgaaaacagcattactaatagtgtcaggagtctttccatactccatacccgcaacattgctggtctggcatacttggcaaaagcaaacccaaagatccggcgttctatgggacgtgcccagtcccccagagacacagaaagcagaactggaagaaggggtctataggatcaagcagcaaggaatttttgggaaaacccaagtaggggttggagtacagaaagaaggagtcttccacaccatgtggcacgtcacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgttagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattttggcaccgacaagggtggttgcagctgagatggaagaagcattgaaaggcctcccaataaggtaccaaacaacagcaacaaaatctgaacacacaggaagagagattgttgatctaatgtgccacgcaacgttcacaatgcgtttgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaagactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtaccgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggggcaatgcttttcttaatatcaggtaaagggattggaaagacctcaataggactcatttgtgtgattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgcgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatctttagagggagctatttagcaggagctgggcttgctttctctattatgaaatcagttggaacaggaaaaagaggaacaggctcacaaggtgaaactttaggagaaaaatggaaaaagaaattaaatcaactatcccggaaagagtttgacctttacaagaaatctggaatcactgaagtggatagaacagaagccaaagaagggttgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacataattaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaaatattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaaaaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgccatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggagaccaaaggagtggagaggttaaaaagaatggccattagcggggatgattgcgtagtgaaaccaattgacgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtttggggaaagcctacgctcaaatgtggagtctcatgtattttcacagaagagacctcagactagcatccaacgccatatgttcagcagtaccagtccactgggtccccacaagcagaacgacatggtctattcatgctcaccatcagtggatgaccacagaagacatgcttactgtctggaacagggtgtggatcgaggacaatccatggatggaagacaaaactccagttacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7245 - RNA, 9873 nt, synthetic construct
  misc_feature 1..9873: note = derived and/or modified CDS sequence (wt) from DENV-3__FJ850089__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcatccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggagggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaacatgagaacctcaaatacaccgtcatcatcacagtgcacacaggagatcaacaccaggtgggaaacgaaacgcagggagtcacggctgagataacacctcaggcatcaaccactgaagtcatcttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagcccacaatggcagactgattacagccaacccagtggtgactaagaaggacgagcctgtcaatattgaggctgaacctccttttggggaaagtaatatagtgattggaattggagacaacgctttgaaaatcaactggtataagaaaggaagctctattgggaagatgttcgaggccactgccagaggtgcaaggcgcatggccatcttgggagacacagcctgggactttggatcagtgggtggtgttctgaactcattaggcaaaatggtgcaccaaatattcggaagtgcttacacagccctattcagtggagtctcttgggtaatgaaagtcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctcttttataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacttgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattggagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttgggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggctggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgaacaaacaggagtgtcccacaacttaatgatcacagttgatgatgatggaacaatgagaataaaagatgatgagactgagaatatcctaacagtacttttgaaaacagcattactaatagtgtcaggagtctttccatactccatacccgcaacattgctggtctggcatacttggcaaaagcaaacccaaagatccggcgttctatgggacgtgcccagccccccagagacacagaaagcagaactggaagaaggggtctataggatcaagcagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcagattattgccgtagagcccgggaagaacccaaagaactttcaaaccatgccaggcacttttcagactacaacaggggaaataggagcaattgcactagatttcaagcctggaacttcaggatctcctatcataaacagagagggaaaggtagtgggactgtatggcaatggagtggttacaaagaatggtggctacgttagcggaatagcgcaaacgaatgcagaaccagatggaccgacaccagaattggaagaagagatgttcaaaaagcgaaatctaaccataatggatcttcatcctgggtcaggaaagacaaggaaataccttccagctattgttagagaggcaatcaagagacgtttgagaactctaattttggcaccgacaagggtggttgcagctgagatggaagaagcattgaaaggcctcccaataaggtaccaaacaacagcaacaaaatctgaacacacaggaagagagattgttgatctaatgtgccacgcaacgttcacaatgcgtttgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaagactaaactgaatgattgggacttcgtggtgacaactgacatttcagaaatgggggctaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctactggacaacattaacacaccagaagggatcataccagctctctttgagccagaaagggagaagtcagccgccatagacggtgagtaccgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagctcatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggggcaatgcttttcttaatatcaggtaaagggattggaaagacctcaataggactcatttgtgtgattgcttccagcggcatgttgtggatggccgaaatcccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccaccacagtaataacaccaatgttaagacataccatagagaattccacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagctactcgcgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagccacaggaccaataacaacactctgggaaggatcacctgggaagttttggaacaccacaatagctgtttccatggcgaacatctttagagggagctatttagcaggagctgggcttgctttttctattatgaaatcagttggaacaggaaaaagaggaacaggctcacaaggtgaaactttaggagaaaaatggaaaaagaaattaaatcaactatcccggaaagagtttgacctttacaagaaatctggaatcactgaagtggatagaacagaagccaaagaagggttgaaaagaggagaaacaacacatcatgccgtgtccagaggtagcgcaaaactccaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaaatattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaactctgggaaggaataaaaaacccaggttatgcacaagggaagagtttacaaaaaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggtagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggagaccaaaggagtggagaggttaaaaagaatggccattagcggggatgattgcgtagtgaaaccaatcgatgacaggttcgctaatgccctgctcgctctgaacgatatgggaaaggttcggaaggacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaatgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7246 - RNA, 9873 nt, synthetic construct
  misc_feature 1..9873: note = derived and/or modified CDS sequence (wt) from DENV-3__FJ850092__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcatccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggagggtgtgtgactaccatggctaagaacaagccaacgttggatatagagcttcagaagaccgaggccacccaattggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaacatgagaacctcaaatacaccgtcatcatcacagtgcacacaggagatcaacaccaggtgggaaacgaaacgcagggagtcacggctgagataacacctcaggcatcaaccactgaagtcatcttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagttacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaataccttcgtgttgaagaaagaagtctcagaaacgcagcatgggacaatactcattaaggtcgagtacaaaggggaagatgcaccttgcaagattcctttctccacagaggatggacaagggaaagcccacaatggcagactgattacagccaacccagtggtgactaagaaggacgagcctgtcaatattgaggctgaacctccttttggggaaagtaatatagtgattggaattggagacaacgctttgaaaatcaactggtataagaaaggaagctctattgggaagatgttcgaggccactgccagaggtgcaaggcgcatggccatcttgggagacacagcctgggactttggatcagtgggtggtgttctgaactcattaggcaaaatggtgcaccaaatattcggaagtgcttacacagccctattcagtggagtctcttgggtaatgaaagtcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccatcgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacttgcacatggccaaaatcacataccctttggagcaatggtgtgctagagagtgacatgatcatcccaaagagtctagctggtcctatttcgcaacacaaccacaggcccgggtaccacacccagacggcgggaccctggcatttaggaaaattggagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttgggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcatcgtagaaaaagcagcagatataacatgggaggaagaggctgaacaaacaggagtgtcccacaacttaatgatcacagttgatgatgatggaacaatgagaataaaagatgatgagactgagaatatcctaacagtacttttgaaaacagcattactaatagtgtcaggagtctttccatactccatacccgcaacattgctggtctggcatacttggcaaaagcaaacccaaagatccggcgttctatgggacgtgcccagccccccagagacacagaaagcagaactggaagaaggggtctataggatcaagcagcaaggaatttttggaaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactagatttcaagcctggaacttcaggatctcctatcataaacagagagggaaaggtagtgggactgtatggcaatggagtggttacaaagaatggtggctacgttagcggaatagcgcaaacgaatgcagaaccagatggaccgacaccagaattggaagaagagatgttcaaaaagcgaaatctaaccataatggatcttcatcctgggtcaggaaagacaaggaaataccttccagctattgttagagaggcaatcaagagacgtttgagaactctaattttggcaccgacaagggtggttgcagctgagatggaagaagcattgaaaggcctcccaataaggtaccaaacaacagcaacaaaatctgaacacacaggaagagagattgttgatctaatgtgccacgcaacgttcacaatgcgtttgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaagactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctactggacaacattaacacaccagaagggatcataccagctctctttgagccagaaagggagaagtcagccgccatagacggtgagtaccgcttgaaaggtgagtctaggaagactttcgtggaactcatgaggaggggtgaccttccagtctggttagcccataaagtagcatcagaagggatcaaatatacagatagaaaatggtgctttgatggacaacgtaacaatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagctcatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtgattgcttccagcggcatgttgtggatggccgaaatcccactccaatggatcgcgtcggctatagtcctggagttttttatgatggtgttgctcataccagaaccagaaaagcaaagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccaccacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagctactcgcgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatctttagagggagctatttagcaggagctgggcttgctttttctattatgaaatcagttggaacaggaaaaagaggaacaggctcacaaggtgaaactttaggagaaaaatggaaaaagaaattaaatcaactatcccggaaagagtttgacctttacaagaaatctggaatcactgaagtggatagaacagaagccaaagaagggttgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaaatattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacctaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaactctgggaaggaacaaaaaacccaggttatgcacaagggaagagtttacaaaaaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtatcttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggtagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggagaccaaaggagtggagaggttaaaaagaatggccattagcggggatgattgcgtagtgaaaccaatcgatgacaggttcgctaatgccctgctcgctctgaacgatatgggaaaggttcggaaggacatacctcaatggcagccatcaaaaggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtttggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7247 - RNA, 9873 nt, synthetic construct
  misc_feature 1..9873: note = derived and/or modified CDS sequence (wt) from DENV-3__FJ850094__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcatccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggagggtgtgtgactaccatggctaagaacaagccaacgttggatatcgagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatataccgtcatcatcacagtgcacacaggagatcaacaccaggtgggaaacgaaacgcagggagtcacggctgagataacacctcaggcatcaaccactgaagccatcttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacgggaacaccaacctggaacaggaaggagcttcttgtgacatttaaaaacgcacatgcgaagaaacaagaagtagtagtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggacgagcctgtcaatattgaggctgaacctcctttcggggaaagtaatatagtgattggaattggagacaacgccttgaaaatcaactggtataagaaaggaagctccattgggaagatgttcgaggccactgccagaggtgcaaggcgcatggccatcttgggagacacagcctgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattctcatgcattgcgataggaatcattacactctatctgggagctgtggtgcaagctgacatgggatgtgttgtaaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacgaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagttaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcagcagctgtcaaggatgagagggccgtacatgccgacatgggctattggatagaaagccaaaagaatggaagttggaagctagaaaaagcatccctcatagaggtgaaaacttgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaatcagacccatcagtgagaaagaagagaacatggtaaagtctttagtctcagcaggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaattgctctggggctcatggctcttaaactgataacacaatttgaaacataccaattatggacagcactaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacatttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgaacaaacaggagtgtcccacaacttaatgatcacagttgatgatgatggaacaatgagaataaaagatgatgagactgagaatatcctaacagtacttttgaaaacagcattactaatagtgtcaggagtctttccatactccatacccgcaacattactggtctggcatacttggcaaaagcaaacccaaagatctggcgttctatgggacgtgcccagccccccagagacacagaaagcagaactggaagaaggggtctataggatcaagcagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacctcaggatctcctatcataaacagagagggaaaggtagtgggactgtatggcaatggagtggttacaaagaatggtggctacgttagcggaatagcgcaaacgaatgcagaaccagatggaccaacaccagaattggaagaagagatgttcaaaaagcgaaatctaaccataatggatcttcatcctgggtcaggaaagacacggaaataccttccagctattgttagagaggcaatcaagagacgtttgagaactctaattttagcaccgacaagggtggttgcagctgagatggaagaagcattgaaaggcctcccaataaggtaccaaacaacagcaacaaaatctgaacacacaggaagagagattgttgatctaatgtgccacgcaacgtttaccatgcgtttgctgtcaccagttagggttccaaactataacttgataataatggatgaagcccatttcacagacccagccagtatagcggctagagggtacatatcgactcgtgttggaatgggagaggcagccgcaatcttcatgacagcaacgccccctggaacagctgatgcctttcctcagagcaacgctccaattcaagacgaagaaagggacataccagaacgctcatggaattcaggcaatgaatggataaccgacttcgctgggaaaacggtgtggtttgtccccagcattaaagccggaaatggcatagcaaactgcttgcgaaaaaacgggaaaaaggtcattcaacttagtaggaagacttttgacacagaatatcagaagactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctagacaacattaatacaccagaaggaatcataccagctctctttgagccagaaagggagaagtcagccgccatagacggtgagtaccgcttgaaaggtgagtctaggaagaccttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggggcaatgcttttcttaatatcaggtaaagggattggaaagacctcaataggactcatttgtgtgattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggctactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcgaaagctactcgcgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcaccggggaagttttggaacaccacgatagctgtttccatggcgaacatctttagagggagctacttagcaggagctgggcttgctttttctattatgaaatcagttggaacaggaaaaagaggaacaggctcacaaggtgaaactttaggagaaaaatggaaaaagaaattaaatcaactatcccggaaagagtttgatctttacaagaaatctggaatcactgaagtggatagaacagaagccaaagaagggttgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaaatattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagttaatatggtatctagactgctactgaacaggttcacgatgacacacagaagacccaccattgagaaagatgtggatttaggagcaggaactcgacatgttaacgcggaaccagaaacacccaacatggatgtcattggggagagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaaaaaggtcagaactaatgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaagggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaacccccatctgccagagaagaaaatcacacaatggttggagaccaaaggagtggagaggttaaaaagaatggccattagcggggatgattgcgtagtgaaaccaatcgatgacaggttcgctaatgccctgctcgctctgaacgatatgggaaaggttcggaaagacataccacaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtcaattcatgctcaccatcagtggatgaccacagaagacatgcttactgtctggaacagggtgtggatcgaggacaatccatggatggaagacaaaactccagttacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggaaggagccatttggtaa

SEQ ID NO: 7248 - RNA, 9873 nt, synthetic construct
  misc_feature 1..9873: note = derived and/or modified CDS sequence (wt) from DENV-3__FJ898446__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttggctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcatttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaactggagacaacgctttgaaaatcaactggtataagaaaggaagctctattgggaagatgttcgagaccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagtggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaaaagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaggatttttggaaacttgtggacagagaacgtgaactccacaaactgggcaagtgcggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7249 - RNA, 9873 nt, synthetic construct
  misc_feature 1..9873: note = derived and/or modified CDS sequence (wt) from DENV-3__GU131844__SS-prME
  source 1..9873: mol_type = other RNA
acatcgctctgcctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttggctccccatgtcggcatgggactagacacacgcacccaaacctggatgtcggctgaaggagcttggaggcaagtcgagaaggtagagacatgggcccttaggcacccagggttcaccatactagctctatttcttgcccattacataggcacatccttgacccagaaggtggttatttttatactactaatgctggtcaccccatccatgacaatgagatgtgtgggagtgggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcccacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaactaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcatttaaaatgtagacttaagatggacaaattggaactcaaagggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaactggagacaacgctttgaaaatcaactggtataagaaaggaagctctattgggaagatgttcgaggccactgccagaggtgcaaggcgcatggccatcttgggagacacagcttgggactttggatcagtgggtggtgttctgaactcattaggtaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctaggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatgtcaaattaacggtagttgtgggcgatataattggggtcttagagcaaggaaaaagaacactaacaccacaacccatggagctgaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttctttacgtttgtgctccttctctcagggcaaataacatggagagacatggcgcacacactaataatgattgggtccaacgcatctgacaggatgggaatgggcgttacctacctagccttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatctttagcttgaaagacacactcaaaaggagaagctggccactgaatgaaggggtgatggctgttgggcttgtgagcattttggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacgggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattaaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagagcgctcatggaattcaggcaatgaatggataaccgacttcgctgggaaaacggtgtggtttgtccccagcattaaagccggaaatgacatagcaaactgcttgcgaaaaaacgggaaaaaggtcatccaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagctgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgctcttcttaatatcaggtaaagggattggaaagacttcaataggactcatttgtgtaattgcttccagtggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaacgaaatgggattgttggaaactacaaaaagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagccatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagctcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggtggtccaggacacgaagaaccagtacccatgtccacatatggatggaacatagttaagttaatgagtggaaaggatgtgttttatcttccacctgaaaagtgtgacaccctgttgtgtgacattggagaatcttcaccaagcccaacggtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaattaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaacccccatctgccagagaagaaaattgcacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgactggcaacaggttcctttctgctcccaccactttcatgaattgatcatgaaagatggaagaaagttggtggttccctgcagaccccaggacgaactaataggaagagcaagaatctctcaaggatcgggatggagccttagagaaaccgcatgtctggggaaagcctacgctcaaatgtggagtctcatgtattttcacagaagagacctcagactagcatccaacgccatatgttcagctgtaccagtccactgggtccccacaagtagaacgacatggtctattcatgctcaccatcagtggatgaccacagaagacatgcttgctgtctggaatagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7250 - RNA, 9873 nt, synthetic construct
  misc_feature 1..9873: note = derived and/or modified CDS sequence (wt) from DENV-3__GU131849__SS-prME
  source 1..9873: mol_type = other RNA
acatcgctctgtctcgtgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacgtcaacatgggtgacttacggaacgtgcaatcaagccggagagcgcagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatattagccctatttcttgcccattacataggcacatccttgacccagaaggtggttatttttatactactaatgctggtcaccccatccatgacaatgagatgtgtgggagtaggaaacagagattttgtagaaggtctatcaggagctacgtgggttgacgtggtgctcgagcacggggggtgtgtgactactatggctaagaacaagccaacgttggatatagagcttcagaagaccgaggccacccaattggcgaccctaaggaaactatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccattgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattaacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagatacagcttgggactttggatcagtgggtggtgttctgaactcattaggcaaaatggtgcaccaaatattcggaagtgcttacacagccctattcagtggagtctcttgggtaatgaaaatcggaataggaattctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcctgggagaatggagtgtgcggaattaggtcaacaaccagaatggagaatctcctgtggaagcaaatagccaatgaactgaactacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatgacgcacacactaataatgattgggtccaacgcatctgacaggatgggaatgggcgttacctacctagctttaattgcaacatttaaaatccagccattcttggctttaggatttttcctaagaaaactgacatccagagaaaatttattgttaggagttgggctggctatggcaacaatgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccacgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattatcagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagctgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaggtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaaacagagaaccccccaagacaaccaactcgcatatgtcgtgataggcatactcacattggctgcaataatagcagctaatgaaatgggattgttggaaactacaaagagagatttaggaatgtctaaggagccaggtgttgtctctccaaccagctatttagatgtggacttgcacccagcatcagcctggacattgtatgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaaccaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcctgaaggaagagtcatagacttgggctgtggaagaggaggctggtcatattactgtgcaggactgaaaaaagtcacagaagtgcgaggatacacaaaaggtggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcaggactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaggccacaggctcagcctcctccatgataaatggagtcgtgaaactcctcactaaaccatgggatgtggtgcccatggtgacacagatggcaatgacagatacaactccttttggccagcagagagtttttaaagagaaagtggacaccaggacacccaggtccatgccaggaacaagaagggtcatggagatcacagcggagtggctctggagaaccctgggaaggaacaaaaaacccaggctatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacgtaccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaactctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgagctaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7251 - RNA, 9873 nt, synthetic construct
  misc_feature 1..9873: note = derived and/or modified CDS sequence (wt) from DENV-3__GQ868546__SS-prME
  source 1..9873: mol_type = other RNA
acatcgctctgtctcgtgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatattagccctatttcttgcccattacataggcacatccttgacccagaaggtggttatttttatactactaatgctggtcaccccatccatgacaatgagatgtgtgggagtaggaaacagagattttgtagaaggtctatcaggagctacgtgggttgacgtggtgctcgagcacggggggtgtgtgactaccatggctaagaacaagccaacgttggatatagagcttcagaagaccgaggccacccaattggcgaccctaaggaaactatgcattgaggggaaaattaccaacataacaactgactcaagatgtcctacccaaggggaagcggttttgcctgaggagcaggaccagaactacgtgtgtaagcatacatacgtggacagaggctgggggaacggatgtggtttgtttggcaagggaagcttggtaacatgtgcgaaatttcaatgcttggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattaacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggaattctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcctgggagaatggagtgtgcggaattaggtcaacaaccagaatggagaatctcctgtggaagcaaatagccaatgaactgaactacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatgacgcacacactaataatgattgggtccaacgcatctgacagaatgggaatgggcgttacctacctagctttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacacaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccacgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattatcagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagctgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtagaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaaacagagaaccccccaagacaaccaactcgcatatgtcgtgataggcatactcacattggctgcaataatagcagctaatgaaatgggattgttggaaactacaaagagagatttaggaatgtctaaggagccaggtgttgtctctccaaccagctatttagatgtggacttgcacccagcatcagcctggacattgtatgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaactcttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaaccaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcctgaaggaagagtcatagacttgggctgtggaagaggaggctggtcatattactgtgcaggactgaaaaaagtcacagaagtgcgaggatacacaaaaggtggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcaggactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccttttggccagcagagagtttttaaagagaaagtggacaccaggacacccaggtccatgccaggaacaagaagggtgatggagatcacagcggagtggctctggagaaccctgggaaggaacaaaaaacccaggctatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgagctaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7252 - RNA, 9873 nt, synthetic construct
  misc_feature 1..9873: note = derived and/or modified CDS sequence (wt) from DENV-3__GU131850__SS-prME
  source 1..9873: mol_type = other RNA
acatcgctctgtctcgtgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatattagccctatttcttgcccattacataggcacatccttgacccagaaggtggttatttttatactactaatgctggtcaccccatccatgacaatgagatgtgtgggagtaggaaacagagattttgtagaaggtctatcaggagctacgtgggttgacgtggtgctcgagcacggggggtgtgtgactaccatggctaagaacaagccaacgttggatatagagcttcagaagaccgaggccacccaattggcgaccctaaggaaactatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattaacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgattaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggaattctcttgacttggatagggttgaattcaaaaaacacatccatgtcattttcatgcattgcgataggaatcattacactctatctgggagctgtggtgcaagctgacataggatgtgttataaactggaaaggcaaagaactcaaatgtggaagtggaatctttgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcactgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtctggcaatcctctttgaagaggtgatgagaggaaaatttgggaagaaacacatgattgcgggggtgttcttcacgtttgtgctccttctctcagggcaaataacatggagagacatgacgcacacactaataatgattgggtccaacgcatctgacaggatgggaatgggcgttacctacctagctttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcagaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattattagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagctgcaattttcatgacagcaacgccccctggaacagctgatgcctttccccagagcaacgctccaattcaagatgaagaaagggacataccagaacgctcatggaattcaggcaatgaatggataaccgacttcgttgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaaacagagaaccccccaagacaaccaactcgcatatgtcgtgataggcatactcacattggctgcaataatagcagctaatgaaatgggattgttggaaactacaaagagagatttaggaatgtctaaggagccaggtgttgtctctccaaacagctatttagatgtggacttgcacccagcatcagcctggacattgtatgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaaccaattatcccggaaagagtttgacctttacaagaaatctggaatcactgaagtggatagaacagaagccaaagaagggttgaaaaaaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggtggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcaggactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccttttggccagcagagagtttttaaagagaaagtggacaccaggacacccaggtccatgccaggaacaagaagggtcatggggatcacagcggagtggctctggagaaccctgggaaggaacaaaaaacccaggctatgcacaagggaagagttcacaaaaaaggtcagaactaacgcagccatgggcgccgttttcacagaggagaaccaatgggacagcgcgaaagctgctgttgaggatgaagatttttggaaacttgtggatagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgagctaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7253 - RNA, 9873 nt, synthetic construct
  misc_feature 1..9873: note = derived and/or modified CDS sequence (wt) from DENV-3__GU131851__SS-prME
  source 1..9873: mol_type = other RNA
acatcgctctgtctcgtgatgatattgccagcagcacttgctttccacttgacttcacgagatggagagccgcacatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatattagccctatttcttgcccattacataggcacatccttgacccagaaggtggttatttttatactactaatgctggtcaccccatccatgacaatgagatgtgtgggagtaggaaacagagattttgtagaaggtctatcaggagctacgtgggttgacgtggtgctcgagcacggggggtgtgtgactaccatggctaagaacaagccaacgttggatatagagcttcagaagaccgaggccacccaattggcgaccctaaggaaactatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggctttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattaacaggagccacagaaatccaaaactcaggaggcacaagtattttcgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatgggcaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggaattctcttgacttggatagggttgaattcaaaaaacacatccatgtcattctcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcctgggagaatggagtgtgcggaattaggtcaacaaccagaatggagaatctcctgtggaagcaaatagccaatgaactgaactacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatgacgcacacactaataatgattgggtccaacgcatctgacagaatgggaatgggcgttacctacctagctttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagacataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacacaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccacgccaggcacttttcagactacaacaggggaaataggagcaattgcactggatttcaagcctggaacttcaggatctcccattataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattatcagagaggcaatcaagagacgtttaagaactctaattttggcaccgacaagggtagttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagctgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaaacagagaaccccccaagacaaccaactcgcatatgtcgtgataggcatactcacattggctgcaataatagcagctaatgaaatgggattgttggaaactacaaagagagatttaggaatgtctaaggagccaggtgttgtctctccaaccagctatttagatgtggacttgcacccagcatcagcctggacattgtatgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaactcttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaaccaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcctgaaggaagagtcatagacttgggctgtggaagaggaggctggtcatattactgtgcaggactgaaaaaagtcacagaagtgcgaggatacacaaaaggtggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcaggactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaatccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccttttggccagcagagagtttttaaagagaaagtggacaccaggacacccaggtccatgccaggaacaagaagggtgatggagatcacagcggagtggctctggagaaccctgggaaggaacaaaaaacccaggctatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgagctaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7254 - RNA, 9873 nt, synthetic construct
  misc_feature 1..9873: note = derived and/or modified CDS sequence (wt) from DENV-3__GQ868547__SS-prME
  source 1..9873: mol_type = other RNA
acatcgctctgtctcgtgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatattagccctatttcttgcccattacataggcacatccttgacccagaaggtggttatttttatactactaatgctggtcaccccatccatgacaatgagatgtgtgggagtaggaaacagagattttgtagaaggtctatcaggagctacgtgggttgacgtggtgctcgagcacggggggtgtgtgactaccatggctaagaacaagccaacgttggatatagagcttcagaagaccgaggccacccaattggcgaccctaaggaaactatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacacgcgaagaaacaagaagtggttgtccttggatcgcaagagggagcaatgcataccgcattaacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggaattctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcctgggagaatggagtgtgcggaattaggtcaacaaccagaatggagaatctcctgtggaagcaaatagccaatgaactgaactacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatggtgacagctgaaacacaaaattcctctttcataatagacgggccgaacacaccggagtgtccaagtgcctcaagagcatggaatgtgtgggaggtggaagattacgggttcggagttttcacaaccaacatatggctgaaactccgagaggtgcacacccaactatgtgaccataggctaatgtcggcagctgtcaaggatgagagggccgtacatgccgacatgggctattggatagaaagccaaaagaatggaagttggaagctagaaaaagcatctctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatgacgcacacactaataatgattgggtccaacgcatctgacagaatgggaatgggcgttacctacctagctttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgccctggggctcatggctcttaaactgataacacaatttgaaacataccaattatggacagcattaatctccttaacgtgttcaaatacaatgtttacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacacaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccacgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattatcagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagctgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgatccaagaagatgtctcaaaccagtgatcctgacagatggaccagagcgggtgatcctggctggaccaatgccagtcaccgcggcgagtgctgcgcaaaggagagggagagttggtaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagaaacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaaacagagaaccccccaagacaaccaactcgcatatgtcgtgataggcatactcacattggctgcaataatagcagctaatgaaatgggattgttggaaactacaaagagagatttaggaatgtctaaggagccaggtgttgtctctccaaccagctatttagatgtggacttgcacccagcatcagcctggacattgtatgccgtggccactacggtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaactcttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaaccaattatcccggaaagagtttgacctttacaagaaatctggaatcactgaagtggatagaacagaagccaaagaagggctgaaaagaggagaaataacacatcatgccgtgtccagaggtagcgcaaaacttcaatggtttgtggagagaaacatggtcattcctgaaggaagagtcatagacttgggctgtggaagaggaggctggtcatattactgtgcaggactgaaaaaagtcacagaagtgcgaggatacacaaaaggtggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcaggactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaatccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccttttggccagcagagagtttttaaagagaaagtggacaccaggacacccaggtccatgccaggaacaagaagggtgatggagatcacagcggagtggctctggagaaccctgggaaggaacaaaaaacccaggctatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttgatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgagctaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7255 - RNA, 9873 nt, synthetic construct
  misc_feature 1..9873: note = derived and/or modified CDS sequence (wt) from DENV-3__GU131857__SS-prME
  source 1..9873: mol_type = other RNA
acatcgctctgtctcgtgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatattagccctatttcttgcccattacataggcacatccttgacccagaaggtggttatttttatactactaatgctggtcaccccatccatgacaatgagatgtgtgggagtaggaaacagagattttgtagaaggtctatcaggagctacgtgggttgacgtggtgctcgagcacggggggtgtgtgactaccatggctaagaacaagccaacgttggatatagagcttcagaagaccgaggccacccaattggcgaccctaaggaaactatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattaacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggaattctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcctgggagaatggagtgtgcggaattaggtcaacaaccagaatggagaatctcctgtggaagcaaatagccaatgaactgaactacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatgacgcacacactaataatgattgggtccaacgcatctgacagaatgggaatgggcgttacctacctagctttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacacaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccacgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattatcagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagctgcaattttcatgacagcaacgccccctggaacagctgatgcctttccccagagcaacgctccaattcaagatgaagaaagggacataccagaacgctcatggaattcaggcaatgaatggataaccgacttcgttgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaaacagagaaccccccaagacaaccaactcgcatatgtcgtgataggcatactcacattggctgcaataatagcagctaatgaaatgggattgttggaaactacaaagagagatttaggaatgtctaaggagccaggtgttgtctctccaaccagctatttagatgtggacttgcacccagcatcagcctggacattgtatgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaactcttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaaccaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcctgaaggaagagtcatagacttgggctgtggaagaggaggctggtcatattactgtgcaggactgaaaaaagtcacagaagtgcgaggatacacaaaaggtggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcaggactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccttttggccagcagagagtttttaaagagaaagtggacaccaggacacccaggtccatgccaggaacaagaagggtgatggagatcacagcggagtggctctggagaaccctgggaaggaacaaaaaacccaggctatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgagctaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7256 - RNA, 9873 nt, synthetic construct
  misc_feature 1..9873: note = derived and/or modified CDS sequence (wt) from DENV-3__GU131858__SS-prME
  source 1..9873: mol_type = other RNA
acatcgctctgtctcgtgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatattagccctatttcttgcccattacataggcacatccttgacccagaaggtggttatttttatactactaatgctggtcaccccatccatgacaatgagatgtgtgggagtaggaaacagagattttgtagaaggtctatcaggagctacgtgggttgacgtggtgctcgagcacggggggtgtgtgactaccatggctaagaacaagccaacgttggatatagagcttcagaagaccgaggccacccaattggcgaccctaaggaaactatgcattgaggggaagattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattaacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgattaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggaattctcttgacttggatagggttgaattcaaaaaacacatccatgtcattttcatgcattgcgataggaatcattacactctatctgggagctgtggtgcaagctgacataggatgtgttataaactggaaaggcaaagaactcaaatgtggaagtggaatctttgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagcggcccatcactgacaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtctggcaatcctctttgaagaggtgatgagaggaaaatttgggaagaaacacatgattgcgggggtgttcttcacgtttgtgctccttctctcagggcaaataacatggagagacatgacgcacacactaataatgattgggtccaacgcatctgacaggatgggaatgggcgttacctacctagctttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattattagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagctgcaattttcatgacagcaacgccccctggaacagctgatgcctttccccagagcaacgctccaattcaagatgaagaaagggacataccagaacgctcatggaattcaggcaatgaatggataaccgacttcgttgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaaacagagaaccccccaagacaaccaactcgcatatgtcgtgataggcatactcacattggctgcaataatagcagctaatgaaatgggattgttggaaactacaaagagagatttaggaatgtctaaggagccaggtgttgtctctccaaacagctatttagatgtggacttgcacccagcatcagcctggacattgtatgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaaccaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggtggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcaggactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccttttggccagcagagagtttttaaagagaaagtggacaccaggacacccaggtccatgccaggaacaagaagggtcatggggatcacagcggagtggctctggagaaccctgggaaggaacaaaaaacccaggctatgcacaagggaagagttcacaaaaaaggtcagaactaacgcagccatgggcgccgttttcacagaggagaaccaatgggacagcgcgaaagctgctgttgaggatgaagatttttggaaacttgtggatagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgagctaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7257 - RNA, 9873 nt, synthetic construct
  misc_feature 1..9873: note = derived and/or modified CDS sequence (wt) from DENV-3__GQ868548__SS-prME
  source 1..9873: mol_type = other RNA
acatcgctctgtctcgtgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatattagccctatttcttgcccattacataggcacatccttgacccagaaggtggttatttttatactactaatgctggtcaccccatccatgacaatgagatgtgtgggagtaggaaacagagattttgtagaaggtctatcaggagctacgtgggttgacgtggtgctcgagcacggggggtgtgtgactaccatggctaagaacaagccaacgttggatatagagcttcagaagaccgaggccacccaattggcgaccctaaggaaactatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcagcatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattaacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggaattctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcctgggagaatggagtgtgcggaattaggtcaacaaccagaatggagaatctcctgtggaagcaaatagccaatgaactgaactacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatgacgcacacactaataatgattgggtccaacgcatctgacagaatgggaatgggcgttacctacctagctttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacacaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccacgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattatcagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagctgcaattttcatgacagcaacgccccctggaacagctgatgcctttccccagagcaacgctccaattcaagatgaagaaagggacataccagaacgctcatggaattcaggcaatgaatggataaccgacttcgttgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaaacagagaaccccccaagacaaccaactcgcatatgtcgtgataggcatactcacattggctgcaataatagcagctaatgaaatgggattgttggaaactacaaagagagatttaggaatgtctaaggagccaggtgttgtctctccaaccagctatttagatgtggacttgcacccagcatcagcctggacattgtatgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaactcttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaaccaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcctgaaggaagagtcatagacttgggctgtggaagaggaggctggtcatattactgtgcaggactgaaaaaagtcacagaagtgcgaggatacacaaaaggtggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcaggactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccttttggccagcagagagtttttaaagagaaagtggacaccaggacacccaggtccatgccaggaacaagaagggtgatggagatcacagcggagtggctctggagaaccctgggaaggaacaaaaaacccaggctatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgagctaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7258 - RNA, 9873 nt, synthetic construct
  misc_feature 1..9873: note = derived and/or modified CDS sequence (wt) from DENV-3__GU131861__SS-prME
  source 1..9873: mol_type = other RNA
acatcgctctgtctcgtgatgatattgccagcagcacttgctttccacttgacttcacgagatggagagccgcgcatgattgtggggaagaatgaaagaggaaaatccctactttttaagacagcctctgggatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgaaaaggtagagacatgggcccttaggcacccagggttcaccatattagccctatttcttgcccattacataggcacatccttgacccagaaggtggttatttttatactactaatgctggtcaccccatccatgacaatgagatgtgtgggagtaggaaacagagattttgtagaaggtctatcaggagctacgtgggttgacgtggtgctcgagcacggggggtgtgtgactaccatggctaagaacaagccaacgttggatatagagcttcagaagaccgaggccacccaattggcgaccctaaggaaactatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattaacaggagccacagaaatccaaaactcaggaggcacaagtatttttgcagggcatttaaaatgtagacttaagatggacaaattggaactcaaggggatgagctatgcaatgtgcacgaatacctttgtattgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggaattctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcctgggagaatggagtgtgcggaattaggtcaacaaccagaatggagaatctcctgtggaagcaaatagccaatgaactgaactacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatgacgcacacactaataatgattgggtccaacgcatctgacaggatgggaatgggcgttacctacctagctttaattgcaacatttaaaatccagccattcttggctttaggatttttcctaaggaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccctccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccacgccaggcacttttcagactacaacaggggaaataggagcaattgcactggatttcaagcctggaacttcaggatctcccatcataaacagagagggaaaggtagtgggactgtatggcaacggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattatcagagaggcaatcaaaagacgtttaagaactctaattttggcaccgacaagggtggttgcagctgagatggaagaagcattgaaagggctcccaataaggtaccaaacaacagtaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagctgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctgtagtcctggagttttttatgatggtgttgcttataccagaaccagaaaaacagagaaccccccaagacaaccaactcgcatatgtcgtgataggcatactcacattggctgcaataatagcagctaatgaaatgggattgttggaaactacaaagagagatttaggaatgtctaaggagccaggtgttgtctctccaaccagctatttagatgtggacttgcacccagcatcagcctggacattgtatgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagttatctagcaggagctgggcttgctttttctattatgaaatcagttggaacaggaaaaagaggaacaggctcacaaggtgaaactttaggagaaaaatggaaaaggaaattaaaccaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcctgaaggaagagtcatagacttgggctgtggaagaggaggctggtcatattactgtgcaggactgaaaaaagtcacagaagtgcgaggatacacaaaaggtggtccaggacacgaagaaccagtacccatgtccacatatggatggaacatagttaagttaatgagtggaaaggatgtgttttatcttccacctgaaaagtgtgacaccctgttgtgtgacattggagaatcttcaccaagcccaacagtggaagaaagcaggactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaagatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccttttggccagcagagagtttttaaagagaaagtggacaccaggacacccaggtccatgccaggaacaagaagggtcatggagatcacagcggagtggctctggagaaccctgggaaggaacaaaaaacccaggctatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgagctaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaaccccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7259 - RNA, 9873 nt, synthetic construct
  misc_feature 1..9873: note = derived and/or modified CDS sequence (wt) from DENV-3__GU131862__SS-prME
  source 1..9873: mol_type = other RNA
acatcgctctgtctcgtgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatattagccctatttcttgcccattacataggcacatccttgacccagaaggtggttatttttatactactaatgctggtcaccccatccatgacaatgagatgtgtgggagtaggaaacagagattttgtagaaggtctatcaggagctacgtgggttgacgtggtgctcgagcacggggggtgtgtgactaccatggctaagaacaagccaacgttggatatagagcttcagaagaccgaggccacccaattggcgaccctaaggaaactatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattaacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgattaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggaattctcttgacttggatagggttgaattcaaaaaacacatccatgtcattttcatgcattgcgataggaatcattacactctatctgggagctgtggtgcaagctgacataggatgtgttataaactggaaaggcaaagaactcaaatgtggaagtggaatctttgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcactgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtctggcaatcctctttgaagaggtgatgagaggaaaatttgggaagaaacacatgattgcgggggtgttcttcacgtttgtgctccttctctcagggcaaataacatggagagacatgacgcacacactaataatgattgggtccaacgcatctgacaggatgggaatgggcgttacctacctagctttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattattagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagctgcaattttcatgacagcaacgccccctggaacagctgatgcctttccccagagcaacgctccaattcaagatgaagaaagggacataccagaacgctcatggaattcaggcaatgaatggataaccgacttcgttgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcctttagcactcaaggaattcaaggactttgcggctggcagaaagtcaatcacccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaaacagagaaccccccaagacaaccaactcgcatatgtcgtgataggcatactcacattggctgcaataatagcagctaatgaaatgggattgttggaaactacaaagagagatttaggaatgtctaaggagccaggtgttgtctctccaaacagctatttagatgtggacttgcacccagcatcagcctggacattgtatgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaaccaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggtggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcaggactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccttttggccagcagagagtttttaaagagaaagtggacaccaggacacccaggtccatgccaggaacaagaagggtcatggggatcacagcggagtggctctggaaaaccctgggaaggaacaaaaaacccaggctatgcacaagggaagagttcacaaaaaaggtcagaactaacgcagccatgggcgccgttttcacagaggagaaccaatgggacagcgcgaaagctgctgttgaggatgaagatttttggaaacttgtggatagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgagctaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7260 - RNA, 9873 nt, synthetic construct
  misc_feature 1..9873: note = derived and/or modified CDS sequence (wt) from DENV-3__GU131865__SS-prME
  source 1..9873: mol_type = other RNA
acatcgctctgtctcgtgatgatattgccagcagcacttgctttccacttgacttcacgagatggagagccgcgcatgattgtggggaagaatgaaagaggaaaatccctactttttaagacagcctctgggatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgaaaaggtagagacatgggcccttaggcacccagggttcaccatattagccctatttcttgcccattacataggcacatccttgacccagaaggtggttatttttatactactaatgctggtcaccccatccatgacaatgagatgtgtgggagtaggaaacagagattttgtagaaggtctatcaggagctacgtgggttgacgtggtgctcgagcacggggggtgtgtgactaccatggctaagaacaagccaacgttggatatagagcttcagaagaccgaggccacccaattggcgaccctaaggaaactatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattaacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggaattctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcctgggagaatggagtgtgcggaattaggtcaacaaccagaatggagaatctcctgtggaagcaaatagccaatgaactgaactacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatgacgcacacactaataatgattgggtccaacgcatctgacaggatgggaatgggcgttacctacctagctttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccctccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccacgccaggcacttttcagactacaacaggggaaataggagcaattgcactggatttcaagcctggaacttcaggatctcccatcataaacagagagggaaaggtagtgggactgtatggcaacggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattatcagagaggcaatcaaaagacgtttaagaactctaattttggcaccgacaagggtggttgcagctgagatggaagaagcattgaaagggctcccaataaggtaccaaacaacagtaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagctgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctgtagtcctggagttttttatgatggtgttgcttataccagaaccagaaaaacagagaaccccccaagacaaccaactcgcatatgtcgtgataggcatactcacattggctgcaataatagcagctaatgaaatgggattgttggaaactacaaagagagatttaggaatgtctaaggagccaggtgttgtctctccaaccagctatttagatgtggacttgcacccagcatcagcctggacattgtatgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagttatctagcaggagctgggcttgctttttctattatgaaatcagttggaacaggaaaaagaggaacaggctcacaaggtgaaactttaggagaaaaatggaaaaggaaattaaaccaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcctgaaggaagagtcatagacttgggctgtggaagaggaggctggtcatattactgtgcaggactgaaaaaagtcacagaagtgcgaggatacacaaaaggtggtccaggacacgaagaaccagtacccatgtccacatatggatggaacatagttaagttaatgactggaaaggatgtgttttatcttccacctgaaaagtgtgacaccctgttgtgtgacattggagaatcttcaccaagcccaacagtggaagaaagcaggactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccttttggccagcagagagtttttaaagagaaagtggacaccaggacacccaggtccatgccaggaacaagaagggtcatggagatcacagcggagtggctctggagaaccctgggaaggaacaaaaaacccaggctatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagtccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgagctaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaaccccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7261 - RNA, 9873 nt, synthetic construct
  misc_feature 1..9873: note = derived and/or modified CDS sequence (wt) from DENV-3__GU131866__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacatcaccgaagtggaacctgaagacattgactgctggtgcaaccttacatcaacatgggtgacttacggaacgtgcaatcaagccggagagcgtagacgcgacaggagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatctttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagatagaggctgggggaacggatgtggtttgtttggcaagggaagcttggtaacatgtgcgaaatttcaatgcctggaactaatagagggaaaagtggtgcagtatgagaacctcaaatacaccgtcatcatcacagtgcacacaggggatcaacaccaggtgggaaatgaaacgcagggagttacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgatatgggatgtgttataaactggaaaggcaaagaactcaaatgtggaagtggaatcttcgtcaccaacgaggtccatgcctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgacataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaattatgtgaccataggctaatgtcggcagctgtcaaggatgagagggccgtacatgccgacatgggctattggatagaaagccaaaagaatggaagttggaaattagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggatttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggattcttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagctaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacactgctggtctggcatacttggcaaaagcaaacccaaagatccggcgttctatgggacgtacccagtcccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcccgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtagttacaaagaatggtggctatgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagagcgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagacttttgtggaactcatgaggaggggtgaccttccagtctggttagcccataaagtagcatcagaagggatcaaatatacagatagaaaatggtgcttcgatggacaacgtaataatcaaattttagaggagaacatggatgtggaaatctggacaaaggaaggagaaaagaaaaaattgaggcctaggtggcttgatgcccgcacttattcagatcccttagcactcaaggaattcaaggactttgcggctggcagaaagtcaatcgcccttgatcttgtgacagaaataggaagagtgccttcacacctagcccacagaacgagaaacgctttggacaatctggtgatgctgcatacgtcagaacatggcggtagggcctacaggcatgcggtggaggaactaccagagacaatggaaacactcctactcttgggactcatgatcttgttgacaggtggggcaatgcttttcttaatatcaggtaaagggattggaaagacttcaataggactcatctgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattattggaaactacaaagagagatttaggaatgtctaaggagccaggtgtcgtctctccaaccagctatttagatgtggacttgcatccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatctcggaaagagtttgacctttacaagaaatctggaatcactgaagtggatagaacagaagctaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaggaaccagtacccatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgagccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctattgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatgggaatcacagcggagtggctctggagaaccctgggaaggaacaaaaagcccaggttatgcacaagggaagagttcacaaagaaggtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggaagttagcgaacgctatatttaagctcacataccaaaacaaagtggtcaaagttcaacgaccgactccaacaggcacggtaatggacatcatatctaggaaagaccaaagaggcagtgggcaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcagatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7262 - RNA, 9873 nt, synthetic construct
  misc_feature 1..9873: note = derived and/or modified CDS sequence (wt) from DENV-3__GU131868__SS-prME
  source 1..9873: mol_type = other RNA
acaccgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgtccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaatataacaactgactcaagatgtcctacccaaggggaagcggttttgcctgaggagcaggaccagaactacgtgtgtaagcacacatacgtagacagaggctgggggaacggatgtggtttgtttggcaagggaagcttggtaacatgtgcgaaatttcaatgcctggaactaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaataacgcacatgcgaagaaacaagaagtagttgtccttggatcgcaagagggagcaatgcataccgcattgacaggagccacagaaatccaaaactcaggaggcacaagtatttttgcggggcatttgaaatgtagacttaagatggataaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagattgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaattattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctctggaagcaaatagccaatgaactgaactacatattgtgggaaaacaatatcaaattaacagtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggcctaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctcattaacgtgttcaaatacaatgttcacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattggtggccgggggcttactgatagcgtgctacgtcataactggcacgtcagcggacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagtgcacaatggcaaaaaggggaggaagtgcaggttattgccgtagagcctgggaagaatccaaagaactttcaaaccatgccaggcacttttcagactacaacaggggaaataggagcaattgcactagatttcaagcctggaacttcaggatctcccatcataaacagagagggaaaggtagtgggactgtatggcaatggagtggttacaaagaatggtggctacgtcagcggaatagcgcaaacgaaagcagaaccagatggaccgacaccagaattggaagaagagatgttcaaaaagcgaaatctaactataatggatcttcatcctgggtcaggaaagacacggaaataccttccagctattgttagagaggcgatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcatccgcaattttcatgacagcaacgccccctggaacagctgatgcctttcctcagagcaatgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccaacctctcaacaatgatgaagaccatgctcactggacagaagcaaaaatgctgctggacaacattaatacaccagaagggatcataccagctctctttgagccagaaagagagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttgatatcaggtaaagggattggaaagacttcaataggactcatttgtgtaattgcttccagcggtatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaagtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggataaaggatggccaatatcaaaaatggacttaggagtacccctactggcattgggttgctattcacaagtgaacccactgactctaacagcggcagtattcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaagtctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagagggggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcctcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtaaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcataagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtgggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgactggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacggaagacatgcttaccgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaatatacccacagcaattcaacaggtgagaagccttataggcaatgaagagtttctggactacatgccttcaatgaagagatttaggaaggaggaggagtcggagggagccatttggtga

SEQ ID NO: 7263 - RNA, 9873 nt, synthetic construct
  misc_feature 1..9873: note = derived and/or modified CDS sequence (wt) from DENV-3__GU131869__SS-prME
  source 1..9873: mol_type = other RNA
acatcgctctgtctcgtgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatattagccctatttcttgcccattacataggcacatccttgacccagaaggtggttatttttatactactaatgctggtcaccccatccatgacaatgagatgtgtgggagtaggaaacagagattttgtagaaggtctatcaggagctacgtgggttgacgtggtgctcgagcacggggggtgtgtgactaccatggctaagaacaagccaacgttggatatagagcttcagaagaccgaggccacccaattggcgaccctaaggaaactatgcattgaggggaaaattaccaacataacaactgactcaagatgtcctacccaaggggaagcggttttgcctgaggagcaggaccagaactacgtgtgtaagcatacatacgtggacagaggctgggggaacggatgtggtttgtttggcaagggaagcttggtaacatgtgcgaaatttcaatgcttggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattaacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacatagcttgggactttggatcagtgggtggtgttctgaactcattaggcaaaatggtgcaccaaatattcggaagtgcttacacagccctattcagtggagtctcttgggtaatgaaaatcggaataggaattctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcctgggagaatggagtgtgcggaattaggtcaacaaccagaatggagaatctcctgtggaagcaaatagccaatgaactgaactacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatgacgcacacactaataatgattgggtccaacgcatctgacagaatgggaatgggcgttacctacctagctttaattgcaacatttaaaatccagccattcttagctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacacaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccacgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattatcagagaggcaatcaagagacgtttaagaactctaattttggcaccgacaagggtggttgcagctgagatggaagaagcattgaaagggctcccaataaggtaccaaacaacagcaacaagatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagctgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaaacagagaaccccccaagacaaccaactcgcatatgtcgtgataggcatactcacattggctgcaataatagcagctaatgaaatgggattgttggaaactacaaagagagatttaggaatgtctaaggagccaggtgttgtctctccaaccagctatttagatgtggacttgcacccagcatcagcctggacattgtatgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaactcttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaaccaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcctgaaggaagagtcatagacttgggctgtggaagaggaggctggtcatattactgtgcaggactgaaaaaagtcacagaagtgcgaggatacacaaaaggtggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcaggactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccttttggccagcagagagtttttaaagagaaagtggacaccaggacacccaggtccatgccaggaacaagaagggtgatggagatcacagcggagtggctctggagaaccctgggaaggaacaaaaaacccaggctatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggagatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgagctaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7264 - RNA, 9873 nt, synthetic construct
  misc_feature 1..9873: note = derived and/or modified CDS sequence (wt) from DENV-3__GU131870__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcatccagggttcaccatattagccctatttcttgcccattacataggcacatccttgacccagaaggtggttatttttatactactaatgctggtcaccccatccatgacaatgagatgtgtgggagtaggaaacagagattttgtagaaggtctatcaggagctacgtgggttgacgtggtgctcgagcacggggggtgtgtgactaccatggctaagaacaagccaacgttggatatagagcttcagaagaccgaggccacccaattggcgaccctaaggaaactatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagaaggagcaatgcataccgcattaacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggaattctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaaccacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaaatctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatgacgcacacactaataatgattgggtccaacgcatctgacaggatgggaatgggcgttacctacctagctttaattgcaacatttaaaatccagccattcttggctttaggatttttcctaagaaaactgacatccagagaaaatttattgctaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcatcgtagaaaaagcagcagacataacatgggaggaagaggctgagcaaacaggagtgtcccataacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggaccttcatcctgggtcaggaaagacacggaaataccttccagctattattagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagctgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaatattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggtatgttgtggatggccgaaatcccactccaatggattgcgtcggctatagtcctggagttttttatgatggtgttgcttataccagaaccagaaaaacagagaaccccccaagacaaccaactcgcatatgtcgtgataggcatactcactttggctgcaataatagcagctaatgaaatgggattgttggaaactacaaagagagatttaggaatgtctaaggagccaggtgttgtctctccaaccagctatttagatgtggacttgcacccagcatcagcctggacattgtatgccgtggccactacagtaataacaccaatgttaagacataccatagagaattctacagcaaatgtgtctctggcagctatagccaaccaggcagtggtcttgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaaccaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggtggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcaggactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccactattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccttttggccagcagagagtttttaaagagaaagtggacaccaggacacccaggtccatgccaggaacaagaagggtcatggggatcacagcggagtggctctggagaaccctgggaaggaacaaaaaacccaggctatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctggtcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgagctaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7265 - RNA, 9873 nt, synthetic construct
  misc_feature 1..9873: note = derived and/or modified CDS sequence (wt) from DENV-3__GU131871__SS-prME
  source 1..9873: mol_type = other RNA
acatcgctctgtctcgtgatgatattgccagcagcacttgctttccacttgacttcacgagatggagagccgcgcatgattgtggggaagaatgaaagaggaaaatccctactttttaagacagcctctgggatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgaaaaggtagagacatgggcccttaggcacccagggttcaccatattagccctatttcttgcccattacataggcacatccttgacccagaaggtggttatttttatactactaatgctggtcaccccatccatgacaatgagatgtgtgggagtaggaaacagagattttgtagaaggtctatcaggagctacgtgggttgacgtggtgctcgagcacggggggtgtgtgactaccatggctaagaacaagccaacgttggatatagagcttcagaagaccgaggccacccaattggcgaccctaaggaaactatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacaacaggagctacaacggaaacaccaacctggaacaggaaggagcttcttgtgacatttaaaaacgcacatgcgaagaaacaagaagtggttgtccttggatcgcaagagggagcaatgcataccgcattaacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggaattctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcctgggagaatggagtgtgcggaattaggtcaacaaccagaatggagaatctcctgtggaagcaaatagccaatgaactgaactacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacacaccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatgacgcacacactaataatgattgggtccaacgcatctgacaggatgggaatgggcgttacctacctagctttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccctccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccacgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattatcagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagctgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaaacagagaaccccccaagacaaccaactcgcatatgtcgtgataggcatactcacattggctgcaataatagcagctaatgaaatgggattgttggaaactacaaagagagatttaggaatgtctaaggagccaggtgttgtctctccaaccagctatttagatgtggacttgcacccagcatcagcctggacattgtatgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagttatctagcaggagctgggcttgctttttctattatgaaatcagttggaacaggaaaaagaggaacaggctcacaaggtgaaactttaggagaaaaatggaaaaggaaattaaaccaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcctgaaggaagagtcatagacttgggctgtggaagaggaggctggtcatattactgtgcaggactgaaaaaagtcacagaagtgcgaggatacacaaaaggtggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcaggactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtagcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccttttggccagcagagagtttttaaagagaaagtggacaccaggacacccaggtccatgccaggaacaagaagggtcatggagatcacagcggagtggctctggagaaccctgggaaggaacaaaaaacccaggctatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgagctaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaaccccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7266 - RNA, 9873 nt, synthetic construct
  misc_feature 1..9873: note = derived and/or modified CDS sequence (wt) from DENV-3__GU131872__SS-prME
  source 1..9873: mol_type = other RNA
acatcgctctgtctcgtgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagttgagaaggtagagacatgggcccttaggcacccagggttcaccatattagccctatttcttgcccattacataggcacatccttgacccagaaggtggttatttttatactactaatgctggtcaccccatccatgacaatgagatgtgtgggagtaggaaacagagattttgtagaaggtctatcaggagctacgtgggttgacgtggtgctcgagcacggggggtgtgtgactaccatggctaagaacaagccaacgttggatatagagcttcagaagaccgaggccacccaattggcgaccctaaggaaactatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacccctaccatggacatcaggagctacaacggaaacaccaacctggaacaggaaggagcttcttgtgacatttaaaaacgcacacgcgaagaaacaagaagtggttgtccttggatcgcaagagggagcaatgcataccgcattaacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggaatcctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcctgggagaatggagtgtgcggaattaggtcaacaaccagaatggagaatctcctgtggaagcaaatagccaatgaactgaactacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatggtgacagctgaaacacaaaattcctctttcataatagacgggccgaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacacgccgacatgggctattggatagaaagccaaaagaatggaagttggaagctagaaaaagcatctctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatgacgcacacactaataatgattgggtccaacgcatctgacagaatgggaatgggcgttacctacctagctttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgccctggggctcatggctcttaaactgataacacaatttgaaacataccaattatggacagcattaatctccttaacgtgttcaaatacaatgtttacgctgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccactggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacacaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccacgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacaaatgcagaaccagatggaccaacaccagaattggaagaagagatgttcaaaaagcgaaatctaaccataatggatcttcatcctgggtcaggaaagacacggaaataccttccagctattatcagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagctgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgatccaagaagatgtctcaaaccagtgatcctgacagatggaccagagcgggtgatcctggctggaccaatgccagtcaccgcggcgagtgctgcgcaaaggagagggagagttggtaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagaaacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaaacagagaaccccccaagacaaccaactcgcatatgtcgtgataggcatactcacattggctgcaataatagcagctaatgaaatgggattgttggaaactacaaagagagatttaggaatgtccaaggagccaggtgttgtctctccaaccagctatttagatgtggacttgcacccagcatcagcctggacattgtatgccgtggccactacggtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaattgggacaggttatgctcctggttttgtgtgcagttcaactcttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaaccaattatcccggaaagagtttgacctttacaagaaatctggaatcactgaagtggatagaacagaagccaaagaagggctgaaaagaggagaaataacacatcatgccgtgtccagaggtagcgcaaaacttcaatggtttgtggagagaaacatggtcattcctgaaggaagagtcatagacttgggctgtggaagaggaggctggtcatattactgtgcaggactgaaaaaagtcacagaagtgcgaggatacacaaaaggtggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcaggactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaatccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccttttggccagcagagagtttttaaagagaaagtggacaccaggacacccaggtccatgccaggaacaagaagggtgatggagatcacagcggagtggctctggagaaccctgggaaggaacaaaaaacccaggctatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttgatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgagctaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatttagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7267 - RNA, 9873 nt, synthetic construct
  misc_feature 1..9873: note = derived and/or modified CDS sequence (wt) from DENV-3__GU131873__SS-prME
  source 1..9873: mol_type = other RNA
acatcgctctgtctcatgatgatattgccagcagcacttgctttccacttgacttcacgagatggagagccgcgcatgattgtgggaaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcggtggcgttagctccccatgtcggcatgggactagacacacgcacccaaacctggatgtcggctgaaggagcttggaggcaagtcgagaaggtagagacatgggcccttaggcacccagggttcaccatactagccctatttcttgctcattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtatgtaagcatacatacgtagacagaggctgggggaacggatgtggtttgtttggcaagggaagcttggtaacatgtgcgaaatttcaatgcctggaactaatagagggaaaagtggtgcagtatgagaacctcaaatacaccgtcgtcatcacagtgcacacaggagatcaacaccaggtgggaaatgaaacgcagggaatcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcataacggcagactgattacagccaacccagtggtgactaagaaggaggagcctgtcaatattgaggctgaacctccttttggggaaagtaacatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatactgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggtttggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagttggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgctcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgctgtagagcctgggaagaacccaaagaactttcaaaccatgccaggcacttttcagactacaacaggggaaataggagcaattgcactggatttcaagcctggaacttcaggatctcccatcataaacagagagggtaaggtagtgggactgtatggcaatggagtggttacaaagaatggtggctacgtcagcggaatagcgcaaacgaatgcagaaccagatggaccgacaccagaattggaagaagagatgttcaaaaagcgaaacctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaatccaagatgaagaaagggacataccagaacgctcatggaattcaggcaatgaatggataaccgacttcgctgggaaaacggtgtggtttgtccccagcattaaagccggaaatgacatagcaaactgcttgcgaaaaaatgggaaaaaggtcattcaacttagtaggaagacttttgacacagaatatcagaaaactaaactgaatgattgggacttcgtggtgacaactgacatttcagaaatgggtgccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacgttaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgcttcgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcataatatcaggtaaagggattggaaagacttcaataggactcatttgtgtaattgcttccagcggcatgctgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgtcgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcttgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactactactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccttacaaaacgtgggcttaccatggatcttatgaagtcaaagccacaggctcagcctcctccatgataaatggagtcgtgaaacttctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacatttaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctgggaaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7268 - RNA, 9873 nt, synthetic construct
  misc_feature 1..9873: note = derived and/or modified CDS sequence (wt) from DENV-3__GU131874__SS-prME
  source 1..9873: mol_type = other RNA
acatcgctctgcctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttggctccccatgtcggcatgggactagacacacgcacccaaacctggatgtcggctgaaggagcttggaggcaagtcgagaaggtagagacatgggcccttaggcacccagggttcaccatactagctctatttcttgcccattacataggcacatccttgacccagaaggtggttatttttatactactaatgctggtcaccccatccatgacaatgagatgtgtgggagtgggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcccacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaactaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcatttaaaatgtagacttaagatggacaaattggaactcaaagggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaactggagacaacgctttgaaaatcaactggtataagaaaggaagctctattgggaagatgttcgaggccactgccagaggtgcaaggcgcatggccatcttgggagacacagcttgggactttggatcagtgggtggtgttctgaactcattaggtaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctaggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctgaaatactcatggaaaacgtggggaaaggcaaaaatagtgacagctgaaacacaaaattcctctttcataatagacgggccgaacacaccggagtgtccaagtacctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagcaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttctttacgtttgtgctccttctctcagggcaaataacatggagagacatggcgcacacactaataatgattgggtccaacgcatctgacaggatgggaatgggcgttacctacctagccttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatctttagcttgaaagacacactcaaaaggagaagctggccactgaatgaaggggtgatggctgttgggcttgtgagcattttggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacgggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattaaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagagcgctcatggaattcaggcaatgaatggataaccgacttcgctgggaaaacggtgtggtttgtccccagcattaaagccggaaatgacatagcaaactgcttgcgaaaaaacgggaaaaaggtcatccaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagctgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgctcttcttaatatcaggtaaagggattggaaagacttcaataggactcatttgtgtaattgcttccagtggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaacgaaatgggattgttggaaactacaaaaagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagccatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagctcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggctcgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcgaaactccaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacccatgtccacatatggatggaacatagttaagttaatgagtggaaaggatgtgttttatcttccacctgaaaagtgtgacaccctgttgtgtgacattggagaatcttcaccaagcccaacggtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaattaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaagacccaggttatgcacaagggaagagttcacaaaaaaggtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaacccccatctgccagagaagaaaattgcacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgactggcaacaggttcctttctgctcccaccactttcatgaattgatcatgaaagatggaagaaaattggtggttccctgcagaccccaggacgaactaataggaagagcaagaatctctcaaggatcgggatggagccttagagaaaccgcatgtctggggaaagcctacgctcaaatgtggagtctcatgtattttcacagaagagacctcagactagcatccaacgccatatgttcagctgtaccagtccactgggtccccacaagtagaacgacatggtctattcatgctcaccatcagtggatgaccacagaagacatgcttgctgtctggaatagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggaaggagccatttggtaa

SEQ ID NO: 7269 - RNA, 9873 nt, synthetic construct
  misc_feature 1..9873: note = derived and/or modified CDS sequence (wt) from DENV-3__GU131875__SS-prME
  source 1..9873: mol_type = other RNA
acatcgctctgtctcgtgatgatattgccagcagcacttgctttccacttgacttcacgagatggagagccgcgcatgattgtggggaagaatgaaagaggaaaatccctacttttcaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatattagccctatttcttgcccattacataggcacatccctgacccagaaggtggttatttttatactactaatgctggtcaccccatccatgacaatgagatgtgtgggagtaggaaacagagattttgtagaaggtctatcaggagctacgtgggttgacgtggtgctcgagcacggggggtgtgtgactaccatggctaagaacaagccaacgttggatatagagcttcagaagaccgaggccacccaattggcgaccctaaggaaactatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattaacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccctgcaagattcctttctccacagaggatggacaagggaaagctcacaatggcagactgatcacagccaacccagtggtgactaagaaggaggagcctgtcaatatcgaggctgaacctccttttggggaaagtaatatagtgattggaattggagacaacgccttgaaaatcaattggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggaattctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaacatcaaattaacggtagttgtgggcgacataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatgacgcacacactaataatgattgggtccaacgcatctgacaggatgggaatgggcgttacctacctagctttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcggcagacctcaccgtagaaaaagcagcagacataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattattagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagctgcaattttcatgacagcaacgccccctggaacagctgatgcctttccccagagcaacgctccaattcaagatgaggaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagtagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagccctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaaacagagaaccccccaagacaaccaactcgcatatgtcgtgataggcatactcacattggctgcaataatagcagctaatgaaatgggattgttggaaactacaaagagagatttaggaatgtctaaggagccaggtgttgtctctccaaccagctatttagatgtggacttgcacccagcatcagcctggacattgtatgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaaccaattatcccggaaagagtttgacctttacaagaaatctggaatcactgaagtagatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggtggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcaggactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtattggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccttttggccagcagagagtttttaaagagaaagtggacaccaggacacccaggtccatgccaggaacaagaagggtcatggggatcacagcggagtggctctggagaaccctgggaaggaacaaaaaacccaggctatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgggaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgagctaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7270 - RNA, 9873 nt, synthetic construct
  misc_feature 1..9873: note = derived and/or modified CDS sequence (wt) from DENV-3__GU131877__SS-prME
  source 1..9873: mol_type = other RNA
acatcgctctgtctcatgatgatattgccagcagcacttgctttccacctgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcccacccaaggggaagcggttttgcctgaggagcaggaccagaactacgtgtgtaagcatacatacgtagacagaggctgggggaacggatgtggtttgtttggtaaaggaagcttggtaacatgtgcgaaatttcaatgcctggaaccaatagaggggaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattgacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcccttctccacagaggatggacaagggaaagctcacaatggcagactgattacagccaacccagtggtaactaagaaggaggagcctgtcaatatcgaggctgaacctccttttggggaaagtaatatagtgattggaattggagacaacgccttgaaaatcaattggtataagaaaggaagctctattgggaagatgttcgaggccactgccagaggtgcaaggcgcatggccatcttgggagacacagcttgggacttcggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggttttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacgaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtaaaaacctgcacatggccaaaatcacataccctttggagtaacggtgtgctagagagtgatatgatcatcccaaagagtctagctggtcctatttcgcaacacaaccacaggcccgggtaccacacccagacagcgggaccctggcatttaggaaaattagagctggacttcaactattgtgaaggaacaacagttgtcatcacagaaaactgtgggacgagaggcccatcattgagaacaacaacagtgtcagggaagttaatacacgaatggtgttgccgttcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggtaatcctctttgaagaggtgatgagaggaaaatttgggaagaagcacatgattgcgggggtgttcttcacgtttgtgctccttctctcagggcaaataacatggagagacatggcgcacacactaataatgattgggtccaacgcatctgacaggatgggaatgggcgttacctatctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgccctggggctcatggctctcaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaataatatcaggagtctttccatactccatacccgcaacattgctggtctggcatacttggcaaaagcaaacccaaagatccggcgttttatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggtcacaaagaatggtggctatgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattattagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttctctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatacacagatagaaaatggtgctttgatggacaacgtaataatcaaattttagaagagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcttacaggcatgcagtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttctttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacgcattatgctatcataggtccaggattgcaggcaaaagccactcgtgaagctcagaaaaggacagccgctggaataatgaagaatccaacggtggatgggataatgacaatagacctagatcctgtgatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagctggacttgctttttctattatgaaatcagttggaacaggaaaaagaggaacaggctcacaaggtgaaactttgggagaaaaatggaaaaagaaattaaatcaattgtcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtagtgcccatggtgatacagatggcaatgacagatacaactccatttggccagcagagagtttttaaagagaaggtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgtttttacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaaactcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgtcagagaagaaaattacacaatggctggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagagtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttagaaaggaggaggagtcggagggagccatttggtaa

SEQ ID NO: 7271 - RNA, 9873 nt, synthetic construct
  misc_feature 1..9873: note = derived and/or modified CDS sequence (wt) from DENV-3__GU131878__SS-prME
  source 1..9873: mol_type = other RNA
acatcgctctgcctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttggctccccatgtcggcatgggactagacacacgcacccaaacctggatgtcggctgaaggagcctggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtgggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcccacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaactaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcatttaaaatgtagacttaagatggacaaattggaactcaaagggatgagctatgcaatgtgcacgaatacctttgtgttgaagaaagaagtctcagaaacgcagcatgggacaatactcatcaaggtcgagtacaagggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaactggagacaacgctttgaaaatcaactggtataagaaaggaagctctattgggaagatgttcgaggccactgccagaggtgcaaggcgcatggccatcttgggagacacagcttgggactttggatcagtgggtggtgttctgaactcattaggtaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctaggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctgaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattaagaacaacaacagtgtcagggaagttaatacacgaatggtgttgccgttcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttctttacgtttgtgctccttctctcagggcaaataacatggagagacatggcgcacacactaataatgattgggtccaacgcatctgacaggatgggaatgggcgttacctacctagccttaattgcaacatttaaaatccagccattcttggctttaggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatctttagcttgaaagacacactcaaaaggagaagctggccactgaatgaaggggtgatggctgttgggcttgtgagcattttggccagttctctccttagaaatgatgtacccatggctggaccattggtggccgggggcttgctaatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacgggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggcaagacacggaaataccttccagccattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagtcagggttccaaattataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagagcgctcatggaattcaggcaatgaatggataaccgacttcgctgggaaaacggtgtggtttgtccccagcattaaagccggaaatgacatagcaaactgcttgcgaaaaaacgggaaaaaggtcatccaacttagcaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaaggcatcataccagctctctttgagccagaaagggagaagtcagctgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgctgacaggtggagcaatgctcttcttaatatcaggcaaagggattggaaagacttcaataggactcatttgtgtaattgcttccagtggcatgttgtggatggccgcaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaacgaaatgggattgttggaaactacaaaaagagatttaggaatgtctaaggagccaggcgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggacagaacagaagccaaagaagggttgaaaagaggagaaataacacatcatgccgtgtccagaggtagcgcaaaacttcaatggttcgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaaccataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggttatggggatcacagcggagtggctctggagaaccctgggaagaaacaaaaaacccaggttatgcacaagggaagagttcacaaaaaaggtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaacccccatctgccagagaagaaaattacacaatggttggaaactaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgactggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgcctggggaaagcttacgctcaaatgtggagtctcatgtattttcacagaagagacctcagactagcatccaacgccatatgttcagctgtaccagtccactgggtccccacaagtagaacgacatggtctattcatgctcaccatcagtggatgaccacagaagacatgcttactgtctggaatagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7272 - RNA, 9873 nt, synthetic construct
  misc_feature 1..9873: note = derived and/or modified CDS sequence (wt) from DENV-3__FJ898455__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagattttgtggaaggcctatcaggagctacgtgggttgacgtggtgctcgagcacggtgggtgtgtgactactatggctaagaacaagcccacgttggatatagagctccagaagaccgaggccacccaactggcgaccctaaggaaactatgtattgagggaaaaattaccaatgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgtagaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaatatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaataacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagatgtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggataacttcacaatgggtgtcttgtgtttggcaatcctctttgaagaggtgatgagaggaaaatttgggaaaaagcacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaatacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactgaatgagggggtgatggctgttggacttgtgagcatcctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgaacaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacacaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcattttccagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaacctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaggaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgtcccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtatgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggggaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagaaaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactcttacagtggagtagaaggagaaggactgcataaactgggatacatcttaagagacatttccaagatacccggaggagctatgtatgctgatgacacagctggttgggacacaagaataacagaagatgacctgcacaatgaggaaaaaatcacacagcaaatggaccctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggcagacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7273 - RNA, 9873 nt, synthetic construct
  misc_feature 1..9873: note = derived and/or modified CDS sequence (wt) from DENV-3__GQ199891__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggcggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagactcaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggaacctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaattattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctttttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggctgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataacgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagcccatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgttgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtag

SEQ ID NO: 7274 - RNA, 9873 nt, synthetic construct
  misc_feature 1..9873: note = derived and/or modified CDS sequence (wt) from DENV-3__FJ898443__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggcggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaactggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtttcttgggtaatgaaaattggaataggagttctcttgacttggataggtttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcatcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctttttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggctgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaattggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaacccgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagcccatagaacgagaaacgctctggacaatctggtgatgctgcatacgtcagaacatggcggtaaagcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattcaacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatccggtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaatgaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgacatgggaaaggttcggaaagacatacctcaatggcagccatctaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatctaacgccatatgttcagcagttccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagttggagggagccatttggtaa

SEQ ID NO: 7275 - RNA, 9873 nt, synthetic construct
  misc_feature 1..9873: note = derived and/or modified CDS sequence (wt) from DENV-3__FJ898444__SS-prME
  source 1..9873: mol_type = other RNA
acatcgctttgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacatgcaatcaagccggagagcatagacgcgataagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggtcgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagctccttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaagttagaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatgaacaagggaaagctcacaatggcagactgattacagccaacccagtggtgactaagaaggaggagcctgtcaatatcgaggctgaacctcctttcggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggggtctcttgggtaatgaaaattggaataggagttctcttgacttggatagggttgaattcgaaaaacacatccatgtcattttcatgcattgcgataggaatcattacactctatctgggagctgtggtgcaagctgacatggggtgtgttgtaaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaagggaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgagtggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatctattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagccatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcacacttggcaaaagcaaacccaaagatccggcgttctatgggatgtacctagccctccagagacacagaaagcagaactggaagaaggggtctataggatcaaacagcaaggaatttttgggaaaacccaggtaggggttggagtacagaaagaaggagtctttcataccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgctgtagagcctgggaagaacccaaagaactttcaaaccatgccaggcacttttcagactacaacaggggaaataggagcaattgcactggatttcaagcctggaacttcaggatctcccattataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcacaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcctataaagtagcatcggaagggatcaaatatacagatagaaaatggtgctttgatggacaacgtaataatcaaattttagaagagaacatggatgtggaaatctggacaaaggaaggagagaagaaaaaattgagacctaggtggcttgatgcccgcacatattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgctcataccagaaccagaaaagcagagaaccccccaagacaaccaactcgcatatgtcgtgataggcatacttacattggcagcaataatagcagccaatgaaatgggattgttggaaactacaaagagagatttaggaatgtctagggagccaggtgttgtttctccaaccagctatttagatgtggacttgcacccagcatcagcctggacattgtacgctgtggccaccacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgagaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaaccttaggagaaaaatggaaaaagaagttaaatcaattatcccggaaagagtttgacctttacaagaaatctggaatcactgaagtggacagaacagaagccaaagaagggttgaaaaaaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggggaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacagattcacgatgacacacagaagacccaccattgagaaagatgtggatttaggagcaggaactcgacatgtcaatgcggaaccagaaacacccaacatggatgtcattggggaaagaataaaaaggatcaaggaagagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtcttcaaagagaaagtggacaccaggacacccaggcccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagttcggcaaagcaaaaggcagtagagcaatatggtacatgtggttgggagccaggtaccttgagttcgaagcccttggattcttaaatgaagaccactggttttcgcgtgagaactcttacagtggagtggaaggagaaggactgcacaagctaggctatatattaagggacatttccaaaatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaacccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7276 - RNA, 9873 nt, synthetic construct
  misc_feature 1..9873: note = derived and/or modified CDS sequence (wt) from DENV-3__FJ898445__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagctatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatccgtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggcggttatttttacattactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcaaaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcacacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttagacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattaacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcaacatgggacaatactcatcaaggtcgagtacaaaggggaagatgtaccttgcaagattcctttctccacagaggatggacaagggaaagctcacaatggcagactgattacagccaacccagtggtgactaagagggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctaggagctgtggtgcaagctgacatggggtgtgttataaactggaaaggcaaagaactcaaatgtggaagtggaatcttcgtcaccaacgaggtccacacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatggaaagccaaaagaatggaagttggaagctagaaaaagcgtccctcatagaggtgaaaacctgcacatggccaaaatcacataccctttggagtaatggtgtgttagagagtgacatgatcattccaaagagtctagctggtcccatctcgcaacacaactacaggcccgggtaccacacccagacggcgggaccctggcatctaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctttttgaagaggtgatgagaggaaaatttgggaagaaacacatgatcgcgggggttttcttcacgtttgtactccttctctcagggcaaataacatggagagatatggcgcacacactaataatgattgggtctaacgcatctgacaggatgggaatgggcgttacctacctagctttaattgcaacatttaaaatccagccattcttggctttgggattcttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgacgtacccatggctggaccattagtggctgggggcttgttgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctggaaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgcgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcctataaagtagcatcagaagggatcaaatatacagatagaaaatggtgctttgatggacaacgcaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagcccatagaacaagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggaatgttggaaactacaaagagagatttaggaatgtctaaggagccaggtgttgcttctccaaccagctatttagatgtggacttgcacccagcatcagcctggacattgtacgctgtggctactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaagttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggttcagcctcctccatgataaatggagtcgtgaaactcctcactaaaccatgggatgtggtgcccatggtgatacagatggcaatgacagatacaactccatttggccagcagagagtctttaaagagaaagtggacactaggacacccaggtccatgccaggaacaagaagggttatggggatcacagcggagtggctctggagaaccctgggaaggaacaaaaaacccaggttatgcacaagggaagagtttacaagaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggctgggagccaggtaccttgaattcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacgtaccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaagttcggaaagacatacctcaatggcagccatcaaagggatggcatgattggcaacaggttcctttctgctcccaccattttcatgaattgatcatgaaagatggaagaaagttggtggttccctgcagaccccaggacgaactaataggaagagcaagaatctctcaaggagcgggatggagccttagagaaaccgcatgtctggggaaagcttacgctcaaatgtggagtctcatgtattttcacagaagagacctcagactagcctccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7277 - RNA, 9873 nt, synthetic construct
  misc_feature 1..9873: note = derived and/or modified CDS sequence (wt) from DENV-3__GQ868571__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggcggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagatagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaacattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctttttgaagaggtgatgagaggaaaatttgggaagaaacacatgattgcgggggttttcttcacgtttgtactccttctctcagggcaaataacatggagagatatggcgcacacactaataatgattgggtctaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggctgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagcccatagaacgagaaacgctctggacaatctggtgatgctgcatacgtcagaacatggcggtaaggcctacaggcatgcggtggaggagctaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggaatgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgtcaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaagtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgccaatgccctgctcgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7278 - RNA, 9873 nt, synthetic construct
  misc_feature 1..9873: note = derived and/or modified CDS sequence (wt) from DENV-3__GU131951__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttacggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggcctatcaggagctacgtgggttgacgtggtgctcgagcacggggggtgtgtgaccaccatgtctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaactcttgggctagaatgctcaccacggacaggtttggacttcaatgaaatgatcttgctaacaatgaagaacaaagcatggatggtacatagacaatggttttttgacctgcctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagctctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacattcaaaatccagccattcttggctttgggattttttctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactctttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttaaaaacagcattactaatagtatcaggaatctttccatactccatacccgcaacattgttggtctggcatacttggcaaaagcaaacccaaagatccggcgttctatgggatgtacctagccctccagaggcacagaaagcagaactggaagaaggggtctataggatcaaacagcaaggaatttttggaaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcactttccagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgactttgctgggaagacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcttgacagatggaccagaacgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagcccatagaacgagaaacgctctggacaatctggtgatgctgcatacgtcagaacatggcggtaaggcctacagacatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagctaaccaggcagtggtcctgatgggtttggacaaaggatggccaatatcaaaaatggacttaggagtacccctactggcattgggttgctattcacaggtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacttcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaagtcagttggaacaggaaaaagaggaacaggctcacagggtgaaactttaggagaaaaatggaaaaagaagttaaatcaattatcccggaaagagtttgacctttacaagaaatctggaatcactgaagtagatagaacagaagccaaagaagggttgaaaagaggagaaataacacatcatgccgtgtccagaggtagcgcaaaacttcaatggtttgtggagagaaacatggtcactcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacacactgttgtgtgacattggagaatcttcaccaagcccaatagtggaagaaagcagaactataagagttttgaagatggtcgaaccatggctaaagaataaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggacttaggagcaggaactcgacatgttaatgcggaaccagaaacacccaacatggatgtcattggggaaagaataaaaaggatcaaggaggagcataattcaacatggcactatgatgacgaaaacccctataaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaaccaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatattcaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaacgccctgctcgctctgaacgatatgggaaaggttcggaaagacatacctcaatggcagccatcaaagggatggcatgattggcagcaggttcctttctgctcccaccactttcatgaattgatcatgaaagatggaagaaagttggtggttccctgtagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggttcccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctaggaaagagagaagaccaatggtgcggatcacttattggtctcacttccagagcaacctgggcccagaacatacccacagcaattcaacaggtgaggagccttataggcaatgaagagtttctggactacatgccttcaatgaagagatttaggaaggaggaggagtcggagggagccatttggtaa

SEQ ID NO: 7279 - RNA, 9873 nt, synthetic construct
  misc_feature 1..9873: note = derived and/or modified CDS sequence (wt) from DENV-3__GQ868572__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgtaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggcggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacgggtgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagctacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagttcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtttcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaacttaaatgtggaagtggaatcttcgtcaccaacgaggtccatacctggacagagcaatacaaattccaagcagactccccaaaaagattggcgacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgcgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctttttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggctgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtagttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagcccatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatccaggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcacaattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagaatttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7280 - RNA, 9873 nt, synthetic construct
  misc_feature 1..9873: note = derived and/or modified CDS sequence (wt) from DENV-3__GQ868573__SS-prME
  source 1..9873: mol_type = other RNA
acatcgttctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggcggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggtcttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacgcctcaggcatcaaccactgaagccatcttgcctgaatatggaacccttgggctagaatgctcaccacggacaggtttggacttcaatgaaatgatcttgctaacaatgaagaacaaagcatggatggtacatagacaatggtttttcgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggtaaaatggtgcaccaaatattcggaagtgcttacacagccctattcagtggagtctcttgggtgatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaatcaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggtttggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacatactctttggagtaatggtgtgttagagagtgacatgatcattccaaagagtctagctggtcctatctcgcaacacaactacaggcccgggtaccacacccagacggcgggaccctggcatttaggaaaattggagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctttttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctgggactcatggctcttaaactgataacacaatttgaaacataccaattatggacagcattaatctccttaacgtgttcaaatacaatttttacgttgactgttgcctggagaacagccaccctgattttggccggagtttcgcttttaccggtgtgccagtcttcgagcatgaggaaaacagactggcttccaatgacagtggcagctatgggacttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggctgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatttgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacctcaggatctcctatcataaacagagagggaaaggtagtgggactgtatggcaatggagtggtcacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgcaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagcccatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccacggatcttatgaagtcaaagccacaggctcagcctcctccatgataaatggagtcgtgaaactcctcactaaaccatgggatgtggtgcccatggtgacgcagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgagaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggtttgctaatgccctgctcgctctgaacgacatgggaaaggttcggaaagacatacctcaatggcagccgtcaaaaggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttaccgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7281 - RNA, 9873 nt, synthetic construct
  misc_feature 1..9873: note = derived and/or modified CDS sequence (wt) from DENV-3__GQ868574__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagctatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggcggttatttttatattactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcacacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggataaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatctaggaaaattagagctggacttcagctattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctttttgaagaggtgatgagaggaaaatttgggaagaaacacatgattgcgggggttttcttcacgtttgtactccttctctcagggcaaataacatggagagatatggcgcacacactaataatgattgggtctaacgcatctgacaggatgggaatgggcgttacctacctagctttaattgcaacatttaaaatccagccattcttggctttgggattcttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggctgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgcgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgagaaggggtgaccttccagtctggttagcccataaagtagcatcagaagggatcaaatatacagatagaaaatggtgctttgatggacaacgcaataatcaaattttagaagagaacatggatgtggaaatctggacaaaggaaggagaaaagaaaaaactgagacctaggtggcttgatgcccgcacctattcagatcccttagcactcaaggaattcaaggactttgcggctggcagaaagtcaatagcccttgatcttgtgacagaaataggaagagtgcctacacacctagcccatagaacgagaaacgctctggacaatctggtgatgctgcatacgtcagaacatggcggtaaggcctacaggcatgcggtggaggaactaccagagacaatggaaacactcctactcttgggactcatgattttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggaatgttggaaactacaaagagagatttaggaatgtctaaggagccaggtgttgcttctccaaccagctatttagatgtggacttgcacccagcatcagcctggacattgtacgctgtggctactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgaattcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcctccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7282 - RNA, 9873 nt, synthetic construct
  misc_feature 1..9873: note = derived and/or modified CDS sequence (wt) from DENV-3__GQ868575__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttcggcacccagggttcaccatactagccctatttcttgcccattacataggcacttccttgacccagaaggcggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaatttttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaatttcacaatgggtgtcctgtgtttggcaatcctttttgaagaggtgatgagaggaaaatttgggaagaaacacatgattgcgggggttttcttcacgtttgtactccttctctcagggcaaataacatggagagatatggcgcacacactaataatgatcgggtccaacgcatctgacaagatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttggcttaaaagacacactcaaaaggagaagctggccactgaatgaaggggtgatggctgttgggcttgtgagcattctggccagttctctccttagaaatgatgtacccatggctggaccattagtggctgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacctggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccgggcacttttcagactacaacaggggaaataggagcaattgcactggatttcaagcctggaacctcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgacctcccagtctggttagcccataaagtagcatcagaagggatcaaatatacagatagaaaatggtgctttgatggacaacgcaataaccaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagcccatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctagggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactgaccctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttccattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcatgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaatacccaacatggatgtcattggggaaagaataaaaaggatcaaggaggagcataattcaacatggcactatgatgacgaaaacccttacaaaacgtgggcttaccatggatcttatgaagtcaaagccacaggctcagcctcctccatgataaatggagtcgtgaaactcctcactaaaccatgggacgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaatgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccaactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgacatgggaaaggtacggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7283 - RNA, 9873 nt, synthetic construct
  misc_feature 1..9873: note = derived and/or modified CDS sequence (wt) from DENV-3__GU131953__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggcggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcctacgttggacatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggggcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatgctgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctttttgaagaggtgatgagaggaaaatttgggaagaaacacatgattgcgggggttttcttcacgtttgtactcctcctctcagggcaaataacatggagagatatggcgcacacactaataatgattgggtccaacgcatctgacaggatgggaatgggcgttacctacctggctttaattgcaacatttaaaatccagccattcttggctttgggatttttcctaagaaaactgacatccagagaaaatttattgttaggagttgggctggctatggcaacaacgttacaactgccagaagacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtagctgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcacacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcatgttacaagaggggcagtattgacatataatgggaaaagactggaaccaaactgggctagcgtgaaaaaagatctgatttcatacggaggaggatggagattgagcgcacaatggcaaaagggggaagaggtacaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaactggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagcatagctgccagagggtacatatcaactcgtgttggaatgggagaagcagccgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaatgggaaaaaggtcattcaacttagtaggaagacttttgacacagaatatcagaaaactaaactgaatgattgggactttgtggtgacgactgacatttcagaaatgggggccaatttcaaagcagacagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagcccatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggaaaagggattggaaagacttcaataggactcatttgtgtaattgcttccagcggcatgttgtggatggccgaaatcccactccaatggatcgcgtcggccatagtcctggagtttttcatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggagatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggctgttggcgaacgctatattcaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagctaatcagacaaatggaaggagaaggtgtgctgtcaaaggcagacctcgagaaccctcatctgtcagagaagaaagttacacaatggttggaaaccaaaggagtggagaggttaaaaagaatggccattagcggggatgattgcgtagtgaaaccaatcgatgacaggttcgctaatgccctgctcgctctgaacgacatgggaaaggttcggaaagacatacctcaatggcagccatcaaagggatggcatgactggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagttccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7284 - RNA, 9873 nt, synthetic construct
  misc_feature 1..9873: note = derived and/or modified CDS sequence (wt) from DENV-3__GQ868577__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaatctcacatcaacatgggtgacttatggaacgtgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggtcgacgtggtgctcgagcacggggggtgtgtgaccaccatggccaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggttagaatgctcaccacggacaggtttggacttcaatgaaatgatcttgctaacaatgaagaacaaagcatggatggtacacagacaatggttctttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacggaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctctacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactcccccaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagagaaagcatccctcatagaggtgaaaacctgcacatggcctaaatcacacaccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtctaatgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaattgataacacaatttgaaacataccaattatggacagcattaatctccttaacgtgttcaaatacaatttttacgttgactgttgcctggagaacagccaccctgattttggccggagtttcgctcttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacctatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttctgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaagttattgccgtagagcctgggaaaaacccaaagaactttcaaaccatgccaggcacttttcagactacaacaggggaaataggagcaatcgcactggatttcaagcctggaacttcaggatctcctatcataaacagagagggaaagatagtgggactgtatggcaatggagtggttacaaagaatggtggctacgtcagcggaatagcgcaaacgaatgcagaaccagatggaccgacaccagaattggaagaagagatgtttaaaaaacgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagctgcaattttcatgacagcaacgccccctggaacagctgatgcctttcctcagagcaacgctccaattcaagatgaagaaagggacataccagaacgctcatggaattcaggcaatgaatggataaccgactttgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgcttctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcctataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggacttcgcagctggtagaaagtcaatagcccttgatcttgtgacagaaataggaagagtgcctacacacctagctcatagaacgagaaacgctctggacaatctggtgatgctgcatacatcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgctcataccagaaccagaaaagcagagaaccccccaagacaaccaactcgcatacgtcgtgataggcatacttacattggcagcaataatagcagccaatgaaatgggattgttggaaactacaaagagagatttaggaatgtccaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagccatagccaaccaggcagtggtcctgatgggtttggacaaaggatggccaatatcaaaaatggacttaggagtacccctgctggcattgggctgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacgctctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactctaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaatatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcctcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataactcaacatggcactatgatgacgaaaacccctacaaaacgtgggcttaccatggatcttatgaagttaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaagagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaagcagacctcgagaaccctcatctgccagagaagaaaattgcacaatggttggagaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaaaataaaactccagtcacaacctgggaaaatgttccatatctagggaagagagaagaccaatggtgcggatcactaattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7285 - RNA, 9873 nt, synthetic construct
  misc_feature 1..9873: note = derived and/or modified CDS sequence (wt) from DENV-3__GU131954__SS-prME
  source 1..9873: mol_type = other RNA
acatcgctttgtctcatgatgatattgccagcagcacttgctttccacttgacttcacgagatggagagccgcgcatgattgtggggaagaatgaaagaggaaaatccctactttttaagacagcttctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacatgcaatcaagccggagagcatagacgcgataagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcaaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacttttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggggtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaataatatcaaattaacggtagttgtgggcgatataattggggtcttagagcaaggaaaaagaacactaacaccacaacccatggagctgaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcctgggtaccacacccagacggcgggaccctggcatttaggaaaactagagctggacttcaactattgtgaaggaacaacagttgtcatcacagaaaactgtgggacaagaggcccatcactgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgagcaaatggcaaatggaatcgctctggggctcatggctcttaaactgataacacaatttgaaacataccaattatggacagcattaatctccttaacgtgttcaaatacaatctttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccattgaatgaaggcgtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacctaatgatcacagttgatgatgatggaacaatgagaataaaagatgatgagactgagaatatcttaacagtgctcttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagattggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggtccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtctccagttagggttccaaactataatttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcctataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcccacacacctagctcatagaacgagaaacgctctggacaatctggtgatgctgcatacgtcagaacatggcggtaaagcctacaggcatgcggtggaggaactaccagagacaatggaaacactcctactcttgggactcatgatcttgttgacaggtggagtaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttagggatgactaaggagccaggtgctgtttctccaaccagctatttagatgtggacttgcacccagcatcagcctggacattgtacgctgtggccactacagtaataacaccaatgttgagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctgggataatgaagaatccaacggtggatgggataatgacaatagacctagatcctgtaatatatgattcaaaatttgaaaagcaactgggacaggttatgctcctggttttgtgtgcagttcaactcttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgccttttctattatgaaatcagttggaacagggaaaagaggaacaggctcacagggtgaaactttgggagaaaaatggaaaaagaagttaaatcaattatcccggaaagagtttgacctttacaagaaatctggaatcactgaagtggatagaacagaagccaaagaagggttaaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacccatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaatgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagccatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaaaatacccggaggagctatgtatgctgatgacacagctggttgggacacaagaataacagaagatgacctgcacaatgaggaaaagatcacacagcaaatggaccctgaacacaggcagttagcaaacgctatatttaagctcacataccaaaacaaagtggtcaaagttcaacgaccgactccaacaggcacggtaatggacatcatatctaggaaagaccaaagaggcagtggacaggtaggaacttacggtctgaacacattcaccaacatggaagcccagttaatcagacaaatggaaggagaaggtgtgctgtcaaaagcagacctcgagaaccctcatctgccagagaagaaagttacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgctcaaatgtggagtctcatgtattttcacagaagagacctcagactagcatccaacgccatatgttcagcagtaccagtccactgggtccccacaagtagaacgacatggtccattcatgctcaccatcagtggatgaccacagaagatatgctcactgtctggaacagggtgtggatcgaggacaatccatggatggaagacaaaactccagtcacaacctgggaaaacgttccatatctagggaagagagaagaccaatggtgcggatcacttattggcctcacttccagagcaacctgggcccagaacatacccacagcaattcaacaggtgagaagccttataggcaatgaagagtttctggactacatgccttcaatgaagagatttaggaaggaggaggagtcggaaggagccatttggtaa

SEQ ID NO: 7286 - RNA, 9873 nt, synthetic construct
  misc_feature 1..9873: note = derived and/or modified CDS sequence (wt) from DENV-3__GQ868578__SS-prME
  source 1..9873: mol_type = other RNA
acatcgctctgtctcatgatgatattgccagcagcacttgctttccacttgacttcacgagatggagagccgcgcatgattgtggggaagaatgaaagaggtaaatccctactttttaagacagcctctggaattaacatgtgcacactcatagccatggacttgggagagatgtgtgatgacacggtcacttacaaatgcccccatattaccgaagtggaacctgaagacattgactgctggtgcaatctcacatcaacatgggtgacttatggaacgtgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccctatttcttgcccattacataggcacttccttgacccagaaggtagttatttttatactactaatgctggtcaccccatccatgacaatgagatgtgtgggagtaggaaacagagattttgtggaaggtctatcaggagctacgtgggtcgacgtggtgctcgagcacggggggtgtgtgaccaccatggctaagaacaagcccacgttggacatagagcttcagaagaccgaggccacccaactggcgaccctaaggaagctatgcattgaggggaaaatcaccaacataacaaccgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaatcaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggttagaatgctcaccacggacaggtttggacttcaatgaaatgatcttgctaacaatgaagaacaaagcatggatggtacacagacaatggttctttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacggaaatccaaaactcaggaggcacaagcatttttgcggggcacttaaaatgtagacttaagatggacaaattagaactcaaggggatgagttatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaatgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaggattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagagaaagcatccctcatagaggtgaaaacctgcaaatggcctaaatcacacaccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccaccagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttctcttcacgtttgtactccttctctcagggcaaataacatggagagatatggcgcacacactaataatgattgggtctaatgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaattgataacacaatttgaaacataccaattatggacagcattaatctccttaacgtgttcaaatacaatttttacgttgactgttgcctggagaacagccaccctgattttggccggagtttcgctcttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcatcctggccagttctctccttagaaatgatgtacctatggctggaccattagtggccgggggcttgctgatagcgtgctacgtcataactggcacgtcagcagacctcaccgtagaaaaagcagcagatgtaacatgggaggaagaggctgagcaaacgggagtgtcccacaacttaatgatcacagttgatgatgatggaacaatgagaataaaagatgatgagactgagaatatcttaacagtgcttctgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaagttattgccgtagagcctgggaaaaacccaaagaactttcaaaccatgccaggcacttttcagactacaacaggggaaataggagcaatcgcactggatttcaagcctggaacttcaggatctcctatcataaacagagagggaaagatagtgggactgtatggcaatggagtggttacaaagaatggtggctacgtcagcggaatagcgcaaacgaatgcagaaccagatggaccgacaccagaattggaagaagagatgtttaaaaaacgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtttgctgtcaccagttagggttccaaactataacttgataataatggatgaagcccatttcacagacccagccagtatagctgctagagggtacatatcaactcgtgttggaatgggagaagcagctgcaattttcatgacagcaacgccccctggaacagctgatgcctttcctcagagcaacgctccaattcaagatgaagaaagggacataccagaacgctcatggaattcaggcaatgaatggataaccgactttgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgcttctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcctataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcagctggtagaaagtcaatagcccttgatcttgtgacagaaataggaagagtgcctacacacttagctcatagaacgagaaacgctctggacaatctggtgatgctgcatacatcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaacttgcatatgtcgtgataggcatacttacattggcagcaataatagcagccaatgaaatgggattgttggaaactacaaagagagatttaggaatgtccaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagccatagccaaccaggcagtggtcctgatgggtttggacaaaggatggccaatatcaaaaatggacttaggagtacccctgctggcattgggctgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacagggccaataacaacgctctgggaaggatcacctgggaagttttggaacaccacgatagctgtttccatggcgaacatttttagagggagctatttagcaggagctgggctcgctttttctatcatgaaatcagttggaacagggaaaagaggaacaggctcacagggtgaaactctaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaatatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcctcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtattggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataactcaacatggcactatgatgacgaaaacccctacaaaacgtgggcttaccatggatcttatgaagttaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaagagaaccaatgggacagcgcgaaagctgctgttgaggatgaggatttctggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaggttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaagcagacctcgagaaccctcacctgccagagaagaaaattgcacaatggttggagaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcaatggatgaccacagaagacatgcttactgtctggaacagggtgtggatcgaggacaatccatggatggaagataaaactccagtcacaacctgggaaaatgttccatatctagggaagagagaagaccaatggtgcggatcactaataggcctcacttccagagcaacctgggcccagaacatacccacagcaattcaacaggtgagaagccttatgggcaatgaagagtttctggactacatgccttcaatgaaaagatttaggaaggaggaggagtcggagggagccatttggtaa

SEQ ID NO: 7287 - RNA, 9873 nt, synthetic construct
  misc_feature 1..9873: note = derived and/or modified CDS sequence (wt) from DENV-3__FJ898457__SS-prME
  source 1..9873: mol_type = other RNA
acatcgctctgtctcatgatgatattgccagcagcacttgctttccacttgacttcacgagatggagagccgcgcatgatagtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaacatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttggataatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggattttttctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggctacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacggcggcagtactcttgctgatcacacattatgccattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaaacagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagaccttgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7288 - RNA, 9873 nt, synthetic construct
  misc_feature 1..9873: note = derived and/or modified CDS sequence (wt) from DENV-3__KF955505__SS-prME
  source 1..9873: mol_type = other RNA
acatcgctctgtctcatgatgatattgccagcagcacttgctttccacttgacttcacgaaatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgattcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctctacagaggatggacaagggaaagctcacaatggcagactgattacagccaacccagtggtgactaagaaggaggagcctgtcaatattgaggctgaacctccttttggggaaagtaatatagtgattggaattggagacaacgccttaaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacctatggagctaaaatactcatggaaaacgtggggaaaggcaaaaatagtgacagctgaaacacaaaattcttctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggccggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccattagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaattgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccaccactaccactctttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggccagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtctaggaagaccttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgaccttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcgatgcttttcttaatatctggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacctctactggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggtcatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaattactgaagtggacagaacagaagccaaagaagggttgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggttatgcccaagggaagagtttacaaaaaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaaaaaacttggagagtttggcaaagcaaaaggtagtagagctatatggtacatgtggttgggagccaggtaccttgagttcgaagcccttggattcctaaatgaagaccactggttttcgcgtgagaactcttacagtggagtggaaggagaaggactgcccaagctaggttatatattaagggacatttccaagatacccggaggagctatgtatgctgatgacacagctggttgggacacaagaataacagaagatgacctgcacaatgaggaaaagatcccccaccaaatggaccctgaacacagccggttagcgaacgctatatttaagctcacataccaaaacaaagtggtcaaagttcaacgaccgactccaacaggcacggtaatggacatcatatctaggaaagcccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattaccggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7289 - RNA, 9873 nt, synthetic construct
  misc_feature 1..9873: note = derived and/or modified CDS sequence (wt) from DENV-3__FJ898464__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgtacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctctacagaggatggacaagggaaagctcacaatggcagactgattacagccaacccagtggtgactaagaaggaggagcctgtcaatattgaggctgaacctccttttggggaaagtaatatagtgattggaattggagacaacgccttaaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagctctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacctatggagctaaaatactcatggaaaacatggggaaaggcaaaaatagtgacagctgaaacacaaaattcttctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggccggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccattagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgataggatgggaatgggcgttacctacctagctttaattgcaacatttaaaatccagccattcttggctttgggattttttctaagaaaactgacatccagagaaaatttattgttaggagttgggctggctatggcaacaacgttacaactgccagaggacattgaacaaatggcaaatggaatcgctctggggctcatggctcttaaattgataacacaatttgaaacataccaattatggacagcattaatctccttaacgtgctcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccgatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgaatatcgcttgaaaggtgagtctaggaagaccttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgaccttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatctggtaaagggattggaaagacctcaataggactcatttgtgtaattgcttccagcggcatgttgtggatggccgagatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacactatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggtcatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggacagaacagaagccaaagaagggttgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggttatgcacaagggaagagtttacaaaaaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggtagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggctggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7290 - RNA, 9873 nt, synthetic construct
  misc_feature 1..9873: note = derived and/or modified CDS sequence (wt) from DENV-3__JQ922556__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtggcgttagctccccatgtcggcatgggactggacacacgcacccaaacctggatgtcggctgaaggagcttggagacaagttgagaaggtagagacatgggcccttaggcacccagggttcaccatactagccctatttcttgcccattacataggcacctccttgacccagaaggtggttatttttatactactaatgctggtcaccccatccatgacaatgagatgtgtgggagtaggaaacagagattttgtggaagggctgtcaggagctacgtgggttgacgtggtgctagagcacggggggtgtgtgaccaccatggctaagaacaagcccacgctggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggttgtggtttgtttggcaagggaagcttggtaacatgtgcgaaatttcaatgcctggaaccgatagagggaaaagtggtgcaatatgagaacctcaaatacaccgtcatcattacagtgcacacaggagaccaacaccaggtgggaaatgaaacgcagggagtcacggctgagataacgcctcaggcatcaactactgaagccatcttgcctgaatatggaacccttgggctagaatgctcaccacggacaggtctggatttcaatgaaatgatcttactaacaatgaagaacaaagcatggatggtacacagacaatggttttttgacctacctctaccatggacatcaggagctacaacagaaacaccaacttggaacaggaaggagctccttgtgacattcaaaaatgcacatgcgaaaaaacaagaagtagttgtccttggatcgcaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgatcacagccaacccagtggtgactaagaaggaggagcctgttaacattgaggctgaacctccttttggggaaagtaatatagtaattggaattggagacaatgccttgaaaatcaactggtacaagaagggaagctctattgggaagatgttcgaggcccctgccagaggtgcaaggcgcatggccatcttgggagacacagcttgggtctttggatcagtaggtggtgttctgaactcattaggcaaaatggtgcaccaaatattcggaagtgcttacacagccctattcagtggagtctcttgggtgatgaaaattggaataggtgtcctcctgacttggatagggttgaattcaaaaaacacatccatgtcattttcatgcatcgcgataggaatcatcacactctatctgggagctgtggtacaagctgacatggggtgtgtcataaactggaaaggcaaagaacttaaatgtggaagtggaattttcgtcaccaacgaggtccatacctggacagagcagtacaaattccaagcggattccccaaaaagattggcgacagctattgcaggcgcttgggagaatggagtgtgcggaattaggtcaacaaccagaatggagaatctcttgtggaagcaaatagccaatgaactgaactacatattatgggaaaacaatatcaaattaacggtagttgtgggcgacacaattggggtcttagagcaaggaaaaagaacactaacaccacaacccatggagctaaaatactcatggaaaacgtggggaaaggcaaaaatagtgacagctgaaacacaaaattcctctttcataatagacgggccaagcacaccggagtgtccaagtgcctcaagagcatggaatgtgtgggaggtggaagattacgggttcggagtcttcacaaccaacatatggctgaaactccgagaggtgtacacccaaatgtgtgaccataggctaatgtcgccagctgtcaaggatgagagggccgtgcatgccgacatgggctattggatagaaagccaaaagaatggaagttggaagctagaaaaagcatccctcatagaggtgaaaacctgcacatggccaaaatcacacactctttggagcaacggtgtgctagagagtgacatgatcattccaaagagtctagctggtcctatttcgcaacacaactacaggcccgggtaccacacccaaacggcaggaccctggcacttaggaaaattggagctggacttcaactattgtgaaggaacaacagttgtcatcacagaaaactgtgggacaagaggcccatcattgagaacgacaacagtgtcaggaaagttgatacacgaatggtgttgccgctcgtgcacacttcctcctctgcgatacatgggagaagacggctgttggtatggcatggaaatcagacccatcagtgagaaagaagagaacatggtaaagtctttagtctcagcgggaagtggaaaggtagacaacttcacaatgggtgtcttgtgtttggcaatcctctttgaagaggtgatgagaggaaaatttgggaagaaacacatgattgcaggggttttcttcacgtttgtgctccttctctcagggcaaataacatggagagacatggcgcacacactaataatgattgggtccaacgcctctgacaggatgggaatgggcgtcacctatctagctttaattgcaacatttaaaatccagccattcctggctttgggatttttcctaagaaaactgacatctagagaaaatttactgttaggagttggactggctatggcaacaacgttacaattgccagaggacattgaacaaatggcaaatggaatcgccctggggctcatggcttttaaattgataacacaatttgaaacataccaattatggacggcattaatctccttaacgtgttcaaatacaattttcacgttgacagttgcctggagaacagccaccctgattttggccggagtttcacttttaccagtgtgccagtcttcgagcatgaggaaaacagactggcttccaatgacagtggcagctatgggagtcccacccctaccactctttatttttagcttgaaagacacactcaaaaggagaagctggccactgaatgaaggggtgatggctgttgggcttgtgagcattctggccagttctctccttagaaatgacgtgcccatggctggaccattagtggccgggggcttgctgatagcgtgctacgtcggaactggcacgtcagcagatcttactgtagaacaagcagcagatgtaacatgggaggaagaggctgagcaaacaggagtgtcccacaacttaatgatcacagttgatgatgatggaacaatgagaataaaagatgatgagactgagaatattctaacagtgcttttgaagacagcattactaatagtatcaggtatctttccatactccatacccgcaacattgttggtctggcatacttggcaaaagcaaacccaaagatccggtgttctatgggacgtacccagccccccagagacacagaaagcagaactggaagaaggggtctataggatcaagcagcaaggaattcttgggaaaacccaagtaggggttggagtacaaaaagaaggagtcttccacaccatgtggcacgtcacaagaggggcagtgttgacacataatgggaaaagactggaaccaaactgggctagcgtgaaaaaagatctgatttcatacggaggaggatggagattgagcccacaatggcaaaagggggaggaggtgcaggttattaccgtagagcctgggaagaacccaaagaactttcaaaccatgccaggcacatttcagactacaacaggggaaataggagcaattgcactggatttcaagcctggaacttcagggtctcctatcataaacagagagggaaaggtagtgggactatatggcaatggagtggttacaaagaatggcggctacgtcagcggaatagcgcaaacaaatgcagaaccagatggaccgacgccagagttggaagaagagatgttcaaaaagcgaaatctaaccataatggatcttcatcctgggtcaggaaagacacggaaataccttccagccattgttagagaggcaatcaacagacgtttaagaactctaattttggcaccgacaagggtggttgcagctgagatggaagaagcattgaaagggctcccaataaggtaccaaacaacagctacaaaatctgaacacacgggaagagagattgttgatctaatgtgccacgcaacgttcacaatgcgcctgctgtcaccagttagggttccaaactataacttgataataatggatgaggcccatttcacagacccagccagtatagcggccagagggtacatatcaactcgtgttggaatgggagaggcagccgcaatttttatgacggcaacgccccctggaacagctgatgcctttcctcagagcaacgctccaattcaagatgaagaaagggacataccagaacgctcatggaattcaggcaatgaatggattaccgactttgccgggaaaacggtgtggtttgtccccagcatcaaagccggaaatgacatagcaaactgcttgcgaaagaacgggaaaaaggtcattcaacttagtaggaagacttttgaaacagaatatcagaagactaaactaaatgattgggactttgtggggacaactgacatttcagaaatgggggccaatttcaaagcagatagagtgatcgacccaagaagatgtctaaaaccggggatcctgacagatggaccagagggggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgttgctggacaacatcaacactccagaaggaatcataccagctctctttgaaccagaaagggagaagtcagccgccatagacggtgaatatcgcctgaaaggtgaatccaggaagactttcgtagaactcatgaggaggggtgaccttccagtttggttagcccacaaagtagcatcagaagggatcaaatatacagatagaaaatggtgctttgatggacagcgcaacaatcaaattttagaggaaaacatggacgtggaaatctggacaaaggaaggagaaaagataaaattaagacctaggtggcttgatgcccgcacttattcagatcccttagcactcaaggaattcaaggactttgccgctggcagaaagtcaatcgcccttgatcttgtgacagaaataggaagagtgccttcacacctagcccacagaacgagaaacgctctggacaatctggtgatgctgcacacgtcagaacatggcggtagggcctacaggcatgcggtggaggaactaccagaaacaatggaaacactcctactcttgggacttatgatcttactgacaggtggagcaatgcttttcttgatatcaggtaaagggattggaaagacttcaataggactcatttgtgtgattgcttccagcggcatgctgtggatggccgaaattccactccaatggatcgcgtcggctatagtcctggagttttttatgatggtgttgcttataccagaaccagaaaagcagagaaccccccaagacaaccaactcgcatatgtcgtaataggcatacttacattggctgcaataatagcggccaatgaaatgggactgttggaaactacaaagagagatttaggagtgtccaaggagccaggtgttgtttctccaactagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactactggcattgggttgctattcacaagtgaacccactgactctaacagcggcagtacttttgctaattacacattatgctattataggtccaggactgcaggcaaaagccactcgtgaagctcaaaaaaggacagctgctggaataatgaagaatccaacggtggatgggataataacaatagacctagatcctgtaatatatgattcaaaatttgaaaagcaactgggacaggtcatgctcctggttttgtgcgcagttcaactgttgttaatgagaacatcatgggccttgtgtgaagctctaactttagctacaggaccaataacaacactctgggaaggatcacctgggaagttttggaataccacgatagctgtttccatggcgaacatttttagagggagctatttagcaggagctgggcttgccttttctattatgaaatcagttggaacaggaaaaagaggaacaggctctcaaggtgaaactttaggagaaaaatggaaaaagaaattgaatcaattatcccggaaagagtttgacctttacaagaagtctggaatcactgaagtggatagaacagaagccaaagaagggttgaaaagaggagaactaacacatcatgccgtgtcgagaggtagtgcaaaacttcaatggtttgtggagagaaacatggtcattcccgaaggaagagtcatagacctgggctgtggaagaggaggctggtcatattactgtgcaggactgaaaaaagtcacagaagtgcgaggatacacaaaaggcggtccaggacacgaagaaccagtgcctatgtcaacatatggatggaacatagttaagttaatgagtggaaaggatgtgttctatcttccacctgaaaagtgtgacaccctgttgtgtgacattggagaatcttcaccaagcccaacagtggaagaaagcagaactataagagttttgaagatggttgaaccatggctgaaaaacaaccagttttgcattaaagtattgaacccttacatgccagccgtgattgagcacctagaaagactacaaaggaaacacggaggaatgcttgtgagaaatccactttcacgaaactccacgcacgaaatgtactggatatctaatggtacaggtaacattgtctcttcagtcaacatggtatccagattgttactgaacaggttcacgatgacacacaggagacctaccatagagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccacggatcttatgaagtcaaggccacaggctcaggctcctccatgataaatggagtcgtgaaacttctcactaaaccatgggatgtggtgcccatggtgacacagatggcaatgacagatacaactccatttggccagcagagagtctttaaagagaaagtggacaccaggacacccaggcctatgccagggacaagaaaggttatggagatcacagcggagtggctctggagaaccctgggaaggaacaaaagacccaggttatgcacaagggaagagtttacaaaaaaggttagaaccaacgcagccatgggcgccgttttcacagaggagaaccaatgggacagtgcgaaagctgctgttgaggatgaagaattttggaaacttgtggacagagaacgtgaactccacaaattaggcaagtgtggaagctgtgtttacaacatgatgggcgggagagagaagaaacttggagagtttggcaaagcaaaaggcagtagagctatatggtacatgtggttgggagccaggtaccttgagttcgaagcccttggattcttgaatgaagaccactggttctcgcgtgaaaactcttacagtggagtagaaggagaaggactgcacaaactaggctacatattaagggacatttccaagatacccggaggagccatgtatgctgatgacacagctggctgggacacaagaataacagaagatgacctgcacaatgaggaaaagatcacacagcaaatggaccctgaacacaggctgttagcgaacgctatatttaagctcacataccaaaacaaagtggtcaaagttcaacgaccgactccaacgggcacggtaatggacatcatatctaggaaagaccaaagaggcagtggacaggtgggaacttatggtctgaatacatttaccaacatggaagcccagttagtcaggcaaatggaaggagaaggtgtgctgtcaaaggcagacctcgagaaccctcatctgccagaaaagaaaatcacacaatggttggaaaccaaaggagtggagaggttaaaaagaatggccattagcggggatgattgcgtagtgaaaccaatcgatgacaggttcgctaacgccctgcttgctctgaacgatatgggaaaggttcggaaagacatacctcaatggcagccatcaaagggatggcatgactggcagcaggttcctttctgctcccaccactttcatgaattgatcatgaaagatggaagaaagttggtggttccctgcagaccccaggacgaactaataggaagagcaagaatctctcaaggagcgggatggagtcttagagaaaccgcatgtttggggaaagcctacgcccaaatgtggagtctcatgtattttcacagaagagatctcagactagcgtccaatgccatatgttcagcagtaccagtccactgggtcaccacaagtagaacgacatggtctattcatgctcaccatcagtggatgaccacagaagacatgcttactgtttggaacagggtgtggatcgaggacaatccatggatggaagacaaaactccagttacaacctgggaaaatgttccatacctagggaagagagaagaccaatggtgcggatcacttattggtctcacttccagagcaacctgggcccagaacatacccacagcaattcaacaggtgagaagccttataggcaatgaagagtttctggactacatgccttcaatgaagagattcaggaaagaggaggagtcggagggagccatttggtaa

SEQ ID NO: 7291 - RNA, 9873 nt, synthetic construct
  misc_feature 1..9873: note = derived and/or modified CDS sequence (wt) from DENV-3__JQ922557__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtggcgttagctccccatgtcggcatgggactggacacacgcacccaaacctggatgtcggctgaaggagcttggagacaagttgagaaggtagagacatgggcccttaggcacccagggttcaccatactagccctatttcttgcccattacataggcacctccttgacccagaaggtggttatttttatactactaatgctggtcaccccatccatgacaatgagatgtgtgggagtgggaaacagagattttgtggaacgtctgtcaggagctacgtgggttgacgtggtgctagagcacggggggtgtgtgaccaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacatacgtagacagaggctgggggaacggttgtggtttgtttggcaagggaagcttggtaacatgtgcgaaatttcaatgcctggaaccgatagagggaaaagtggtgcaatatgagaacctcaaatacaccgtcatcattacagtgcacacaggagaccaacaccaggtgggaaatgaaacgcagggagtcacggctgagataacgcctcaggcatcaactactgaagccatcttgcctgaatatggaacccttgggctagaatgctcaccacggacaggactggatttcaatgaaatgatcttactaacaatgaagaacaaagcatggatggtacacagacaatggttttttgacctacctctaccatggacatcaggagctacaacagaaacaccaacttggaacaggaaggagctccttgtgacattcaaaaatgcacatgcgaaaaaacaagaagtagttgtccttggatcgcaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgatcacagccaacccagtggtgactaagaaggaggagcctgttaacattgaggctgaacctccttttggggaaagtaatatagtaattggaattggagacaatgccttgaaaatcaactggtacaagaaaggaagctctattgggaagatgttcgaggccactgccagaggtgcaaggcgcatggccatcttgggagacacagcttgggactttggatcagtaggtggtgttctgaactcattaggcaaaatggtgcaccaaatattcggaagtgcttacacagccctattcagtggagtctcttgggtgatgaaaattggaataggtgtcctcctgacttggatagggttgaattcaaaaaacacatccatgtcattttcatgcatcgcgataggaatcatcacactctatctgggagctgtggtacaagctgacatggggtgtgtcataaactggaaaggcaaagaacttaaatgtggaagtggaattttcgtcaccaacgaggtccatacctggacagagcagtacaaattccaagcggattccccaaaaagattggcgacagctattgcaggcgcttgggaaaatggagtgtgcggaattaggtcaacaaccagaatggagaatctcttgtggaagcaaatagccaatgaactgaactacatattatgggaaaacaatatcaaattaacggtagttgtgggcgacacaattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaaatgtgtgaccataggctaatgtcggcagccgtcaaggatgagagggccgtgcatgccgacatgggctattggatagaaagccaaaagaatggaagttggaagctagaaaaagcatccctcatagaggtgaaaacctgcacatggccaaaatcacacactctttggagcaacggtgtgctagagagtgacatgatcattccaaagagtctagctggtcctatttcgcaacacaactacaggcccgggtaccacacccaaacggcaggaccctggcacttaggaaaattggagctggacttcaactattgtgaaggaacaacagttgtcatcacagaaaactgtgggacaagaggcccatcattgagaacgacaacagtgtcaggaaagttgatacacgaatggtgttgccgctcgtgcacacttcctcctctgcgatacatgggagaagacggctgttggtatggcatggaaatcagacccatcagtgagaaagaagagaacatggtaaagtctttagtctcagccgggaaaagtaaaagggacaactccacaatgggtgtcttgtgtttggcaatcctctttgaagaggtgatgagaggaaaatttgggaagaaacacatgattgcaggggttttcttcacgtttgtgctccttctctcagggcaaataacatggagagacatggcgcacacactaataatgattgggtccaacgcctctgacaggatgggaatgggcgtcacctatctagctttaattgcaacatttaaaatccagccattcctggctttgggatttttcctaagaaaactgacatctagagaaaatttaatgttaggagttggactggctatggcaacaacgttacaattgccagaggacattgaacaaatggcaaatggaatcgccttggggctcatggctcttaaattgataacacaatttgaaacataccaattatggacggcattaatctccttaacgtgttcaaatacaattttcacgttgactgttgcctggagaacagccaccctgattttggccggagtttcacttttaccagtgtgccagtcttcgagcatgaggaaaacagactggcttccaatgacagtggcagctatgggagtcccacccctaccactctttatttttagcttgaaagacacactcaaaaggagaagctggccactgaatgaaggggtgatggctgttggacttgtgagcattctggccagttctctccttagaaatgacgtgcccatggctggaccattagtggccgggggcttgctgatagcgtgctacgtcataactggcacgtcagcagacctcacagtagaaaaagcagcagatgtaacatgggaggaagaggctgagcaaacaggagtgtcccacaacttattgatcacagttgatgataatggaacaatgagaataaaggatgatgagactgagattattctaacagtgcttttgaagacagcattacaaatagtatcgggtatctttccatactccatacccgcaacattgttggtctggcatacttggcaaaagcaaacccaaagatccggtgttttatgggacgtacccagccccccagagacacagaaagcagaactggaagaaggggtctataggatcaagcagcaaggaattcttgggaaaacccaagtaggggttggagtacaaaaagaaggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacatttcagactacaacaggggaaataggagcaattgcactggatttcaagcctggaacctcagggtctcctatcataaacagagagggaaaggtagtgggactatatggcaatggagtggttacaaaaaatggagactacctcagcggaatagcgcaaacaaatgcagaaccatacggaccgtcaccagatttggaagaagagatgttcaaaaagcgaaaactaaccataatggatcttcatcctgggtcaggccagactttgaaataccttccagccattgttagagacgcaatcaagagacgtttaagaatcttaattttggcaccgacaagggtggttgcagctgagatggaagaagcattgaaagggctcccaataaggtaccaaacaacagcaacaaaatctgaacacacgggaagagagattgttgatctaatgtgccacgcaacgttcacaatgcgcttgctgtcaccagttagggttccaaactataacttgataataatggatgaggcccatttcacagacccagccagtatagcggccagagggtacatatcaactcgtgttggaatgggagaggcagccgcaatttttatgacggcaacgccccctggaacagctgatgcctttcctcagagcaacgctccaattcaggatgcagaaagggacataccagaacgctcatggaattcaggcaatgaatggatcaccgactttgccgggaaaacggtgtggtttgtccccagcatcaaagccggaaatgacatagcaaactgcttgcgaaagaacgggaaaaaggtcattcaacttagtaggaagacttttgaaacagaatatcagaagactaaactaaatgattgggactttgtggtgacaactgacatttcagaaatgggggccaatttcaaagcagatagagtgatcgacccaagaagatgtctaaaaccagtgatcctgacagatggaccaaagcgggtgatcctggctggacctatgccagacaccgcggccagtgctgcgcaaaggagagggagagttggcaggaacccacaaaaagaaaatgaccagtacatattcccgggccagcctctcaacactgatgaagaccatgctcactggcctgaaacaaaactgttgatggacttattcaccactccagagggaatcttaccgtctcactttgatccacatggggagaattttcccgaaatatccggtgaatatcgcctgaaaggtgaatccaggaagactttcgtagaactcatgaggaggggtgaccttccagtttggttagcccacaaagtagcatcagaagggatcaaatatacagatagaaaatggtgctttgatggacagcgcaacaatcaaattttagaggaaaacatggacgtggaaatctggacaaaggaaggagaaaagaaaaaattaagacctaggtggcttgatgcccgcacttattcagatcccttagcactcaaggaattcaaggactttgcggctggcagaaagtcaatcgcccttgatcttgtgacagaaataggaagagtgccttcacacctagcccacagaacgagaaacgctctggacaatctggtgatgctgcacacgtcagaacatggcggtagggcctacaggcatgcggtggaggaactaccagaaacaatggaaacactcctactcttgggactcatgatcttactgacaggtggagcaatgcttttcttgatatcaggtaaagggattggaaagacttcaataggactcatttgtgtgattgcttccagcggcatgctgtggatggccgaaattccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcggccaatgaaatgggactgttggaaactacaaagagagatttaggaatgtctaaggagccaggtgttgtttctccaactagctatttggatgtggactcacacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactactggcattgggttgctattcacaagtgaacccactgactctaacagcggcagtacttttgctaattacacattatgctattataggtccaggactgcaggcaaaagccactcgtgaagctcaaaaaaggacagctgctggaataatgaagaatccaacggtggatgggataataacaatagacctagatcctgtaatatatgattcaaaatttgaaaagcaactgggacaggtcatgctcctggttttgtgcgcagttcaactgttgttaatgagaacatcatgggccttgtgtgaagctctaactttagctacaggaccaatgacaacactctgggaaggatcgcctgggaagatttggaataccacgatagctgtttccatggcgaacatttttagagggagctatttagcaggagctgggcttgccttttctattatgaaatcagttggaacaggaaaaagaggaacaggctctcaaggtgaaactttaggagaaaaatggaaaaagaaattgaatcaattgtcccggaaagagtttgacctttacaagaagtctggaatcactgaagtggatagaacagaagccaaagaagggttgaaaagaggagaaacaacacatcatgccgtgtcgagaggtagtgcaaaacttcaatggtttgtggagagaaacatggtcattcccgaaggaagagtcatagacctgggctgtggaagaggaggctggtcatattactgtgcaggactgaaaaaagtcacagaagtgcgaggatacacaaaaggcggtccaggacacgaagaaccagtgcctatgtcaacatatggatggaacatagttaagttaatgagtggaaaggatgtgttctatcttccacctgaaaagtgtgacaccctgttgtgtgacattggagaatcttcaccaagcccaacagtggaagaaagcagaactataagagttttgaagatggttgaaccatggctgaaaaacaaccagttttgcattaaagtattgaacccttacatgccagccgtgattgagcacctagaaagactacaaaggaaacacggaggaatgcttgtgagaaatccactttcacgaaactccacgcacgaaatgcactggatatctaatggtacaggtaacattgtctcttcagtcaacatggtatccagattgttactgaacaggttcacgatgacacacaggagacccaccatagagaaagatgtggatttaggagcaggaactcgacatgttaatgcggaaccagaaacacccaacatggatgtcattggggaaagaataaaaaggatcaaggaggagcataattcaacatggcactatgatgacgaaaatccttacaaaacgtgggcttaccatggatcctatgaagtcaaagccacaggctcagcctcctccatgataaatggagtcgtgaaactcctcactaaaccatgggatgtggtgcccatggtgacacagatggcaatgacagatacaaccccatttggccagcagagagtttttaaagagaaagtggacaccaggacacccaggcccatgccagggacaagaaaggttatggagatcacagcggagtggctctggagaaccctgggaaggaacaaaagacccagattatgcacaagggaagagtttacaaaaaaggttagaaccaacgcagccatgggcgccgttttcacagaggagaaccaatgggacagtgcgaaagctgctgttgaggatgaagaattttggaaacttgtggacagagaacgtgaactccacaaattaggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttgaatgaagaccactggttctcgcgtgaaaactcttacagtggagtagaaggagaaggactgcacaaactaggctacatattaagggacatttccaagatacccggaggagccatgtatgctgatgacacagctgggtgggacacaagaataacagaagatgacctgcacaatgaggaaaagatcacacagcaaatggaccctgaacacaggctgttagcgaacgctatatttaagctcacataccaaaacaaagtggtcaaagttcaacgaccgactccaacgggcacggtaatggacatcatatctaggaaagaccaaagaggcagtggacaggtgggaacttatggtctgaatacatttaccaacatggaagcccagttagtcaggcaaatggaaggagaaggtgtgctgtcaaaggcagacctcgagaaccctcatctgccagaaaagaaaatcacacaatggttggaaaccaaaggagtggagaggttaaaaagaatggccattagcggggatgattgcgtagtgaaaccaatcgatgacaggttcgctaacgccctgcttgctctgaacgatatgggaaaggttcggaaagacatacctcaatggcagccatcaaagggatggcatgactggcagcaggttcctttctgctcccaccactttcatgaattgatcatgaaagatggaagaaagttggtggttccctgcagaccccaggacgaactaataggaagagcaagaatctctcaaggagcgggatggagtcttagagaaaccgcctgtttggggaaagcctacgcccaaatgtggagtctcatgtattttcacagaagagatctcagactagcgtccaatgccatatgttcagcagtaccagtccactgggtccccacaagtagaacgacatggtctattcatgctcaccatcagtggatgactacagaagacatgcttactgtttggaacagggtgtggatcgaggacaatccatggatggaagacaaaactccagttacaacctgggaaaaccctccatacttagggaagagagaagaccaatggtgcggatcaattattggtctatcttccagagcaacctgggcccagaacatacccacagcaattcaacaggtgagaagccttataggcaatgaagagtttctggactacatgccttcaatgaagagattcaggaaagaggaggagtcggagggagccatttggtaa

SEQ ID NO: 7292 - RNA, 9873 nt, synthetic construct
  misc_feature 1..9873: note = derived and/or modified CDS sequence (wt) from DENV-3__JQ922555__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcgacatgggtgacttatggaacgtgcaatcaagctggagagcatagacgcgataagagatcagtggcgttagctccccatgtcggcatgggactggatacacgcacccaaacctggatgtcggctgaaggagcttggagacaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggtgggtgtgtgactaccatggctaagaacaagcccacgctggatatagagcttcagaagaccgaggccacccaactggcgaccctaaggaagctatgcattgagggaaaaattaccaacataacaactgactcaaggtgtcctacccaaggggaagcggttttgcctgaggagcaggaccagaactacgtgtgtaagcatacatacgtagacagaggctgggggaacggttgtggtttgtttggcaagggaagcttggtaacatgtgcgaaatttcaatgtctagaatcaatagagggaaaagtggtgcaatatgagaacctcaaatacaccgtcatcattacagtgcacacaggagaccaacaccaggtgggaaatgaaacgcagggagtcacggctgagataacaccccaggcatcaaccgctgaagccatcttgcccgaatatggaacccttgggctagaatgctcaccacggacaggtttggatttcaatgagatgatcttactgacaatgaagaacaaagcatggatgggacatagacaaatgctcttcgacctccccacaccatggacatcaggaactacaacagaaacatcagcctggaacaggaaagaaccttttgtgacattcaaaaacgcacatacaaaaaaacaagaagtggttgtccttggatcgcaagagggagctatgcatacagcactgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcgttaaggtcgagtacaaaggggaagatgcaccttgcaagattcctttctccacagaggatggacaagggaaagctcacaatggcagactgatcacagccaacccagtggtgactaagaaggaggagcctgtcaatattgaggctgaacctccttttggggaaagtaatatagtaattggaattggagacaaagccttgaaaatcaactggtacaggaagggaagctcgattgggaagatgtttgaggccacttccagaggtgcaaggcgcatggccatcttgggagacacagcctgggactttggatcagtgggtggtgttctgaactcattgggcaaaatggtgcaccaaatatttggaagtgcttacacagccctatttagtggagtctcttgggtaatgaaaattggaataggtgtcctcttaacttggatagggttgaattcaaaaaacacatccatgtcattttcatgtattgcgataggaatcattacactctatctgggagccgtggtacaagctgacatggggtgtgtcataaactggaaaggcaaagaactcaaatgtggaagtggaattttcgtcaccaacgaggtccatacctggacagagcaatacaaatttcaagcagactccccaaaaagactggcgacagccattgcaggcgcttgggagaatggagtatgcggaattaggtcaacaaccagaatggagaatctcttgtggaagcaaatagccaatgaactgaactacatattatgggaaaacaatatcaaattaacggtagttgtgggcgacacaattggggtcttagagcaagggaaaagaacactaacaccacaacccatggagctaaaatattcatggaaaacgtggggaaaggcaaaaatagtgacagctgaaacacaaaattcctctttcataatagatgggccaaacacaccggagtgtccaagtgcctcaagagcatggaatgtgtgggaggtggaagattacgggttcggagtcttcacaaccaatatatggctgaaactccgagaggtgtacacccaaatatgtgaccataggctaatgtcggcagccgtcaaggatgagagggccgtacatgccgacatgggctattggatagaaagccaaaagaatggaagttggaagctagaaaaagcatccctcatagaggtgaaaaccagcacatggccaaaatcacacactctttggagtaatggtgtgcaagagagtgacatgatcatcccaaagagtctagctggtcctatttcgcaacacaactacaggcccgggtaccacacccaaacggcaggaccctggcacttaggaaaattggagctggatttcaactattgtgaaggaacaacagttgtcatcacagaaaactgtgggacaagaggcccatcattgagaacaacaacagtgtcagggaagttgatacacgagtggtgttgccgctcgtgcacacttcctcccctgcgatatatgggagaagacggctgctggtatggcatggaaattagacccatcagtgagaaagaagagaacatggtaaagtctttagcctcagcaggaagtggaaaggtggacaacttcacaatgggtgtcctgtgtttggcaatcctctttgaagaggtgatgagaggaaaatttgggaagaaacacatgattgcaggggttctcttcacgtttgtgctccttctctcagggcaaataacatggagagacatggcgcgcacactcataatgattgggtccaacgcctctgacaggatgggaatgggagtcacttacctagctttaattgcaacatttaaaatccagccattcttggctttaggattcttcctgaggaaactgacatctagagaaaatttattgttgggagttgggttggctatggcaacaacgttacaactgccagaggacattgaacaaatggcaaatggaatcgctctggggctcatggctcttaaactgataacacaatttgaaacatatcaattatggacggcattagtctccctaacgtgttcaaatacaatttttacgttgactgttgcctggagaacagccaccctaattttggccggagtttcgcttttgccagtgtgccagtcttcgagcatgaggaaaacagattggctcccaatgactgtggcagctatgggagttccacccctaccactttttatttttagcttgaaagatacactcaaaaggagaagctggccactaaatgagggggtgatggctgttgggctcgtgagcattctagccagttctctccttaggaatggtgtgcccatggctggaccactagtggccgggggcttgcttatagcgtgttacgtcataactggcacgtcagcagacctcactgtagaaaaagcagcagatgtaacatgggaggaagaggctgagcaaacaggagtgtcccacaatttaatgatcacagttgatgatgatggaacaatgagaataaaagatgatgagactgagaacatcctaacagtgcttttaaaaacagcattactaatagtatcaggcatttttccatactccatacccgcaacattgttggtctggcatacttggcaaaagcaaacccaaagatccggcgttttatgggacgtacccagccccccagagacacagaaagcagaactggaagaaggggtctataggatcaaacagcaaggaatttttgggaaaacccaagtgggggttggagtacagaaagaaggagtcttccacaccatgtggcacgtcacaagaggggcagtgttgacacataatgggaaaagactggaaccaaactgggctagcgtgaaaaaagatctgatttcatacggaggaggatggagattgagtgcacaatggcaaaagggagaggaggtgcaggttattgccgtagagcctgggaagaacccaaagaactttcaaaccatgccgggcacttttcagactacatcaggggaaataggagcaattgcactggattttaagcctggaacttcaggatctcctatcataaatagagagggaaaggtagtgggactgtatggcaatggagtggttacaaagaatggtggctacgtcagcggaatagcgcaaacaaatgcagaaccagacggaccgacaccagagttggaagaagagatgttcaaaaagcgaaatctaaccataatggatcttcatcctgggtcaggaaagacgcggaaataccttccagctattgttagagaggcaatcaagagacgcttaagaactctaattttggcaccgacaagggtggttgcagctgagatggaagaagcattgaaagggctcccaataaggtaccaaacaactgcaacaaaatctgaacacacaggaagagagattgttgacctaatgtgccacgcaacgttcacaatgcgcttgctgtcaccagttagggttccaaattacaacttgataataatggatgaggcccatttcacagacccagccagtatagcggctagagggtacatatcaactcgtgtaggaatgggagaggcagccgcaattttcatgacagcaacaccccctggaacagctgatgcctttcctcagagcaacgctccaattcaagatgaagaaagggacataccagaacgctcatggaattcaggcaatgaatggattaccgactttgctgggaagacggtgtggtttgtccctagcattaaagccggaaatgacatagcaaactgtttgcgaaaaaacgggaaaaaggtcattcaacttagtaggaagacctttgacacagaatatcaaaagactaaattgaatgattgggacttcgtggtgacaactgacatttcagaaatgggagccaatttcaaagcagatagagtgatcgacccaagaagatgtctcaaaccagtgattttgacagatggacccgagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcactggacagatgcaaaaatgctgctggagaacatcaacacaccagaagggattataccagctctctttgaaccagaaagggagaagtcggccggtttagacggtgaataccgcctgaagggtgagtccaggaagactttcgtggaactcatgaggaggggtgacctcccagtttggttagcccataaagtagcatcagaagggatcttatacacagataggaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggattttgcagctggcagaaagtcaatcgcccttgatcttgtgacagaaataggaagagtgtcttcacacttagcccacagaacgagaaacgctctggacaacaaaatgatgctgcacacgtcagaatatggcggaagggcctacaggcatgcagtggaggaactaccagaaacaatggaaacactcctactcttgggactcatgatcttgttgacaggtggagcaatgcttttcttgatatcaggtaaagggattggaaagacttcaataggactcatttgtgtaattgcttccagcggtatgttatggatggccgatgtcccactccaatggatcgcgtcggctatagtcctggagttttttatgatggtgttgcttataccagaaccagaaaagcagagaactccccaagacaaccaactcgcatatgtcgtgataggcatacttacattggctgcaataatagcggccaatgaaatgggactgttggaaactacaaagagagatttaggagtgtccaaggagccaggtgttgtttctccaactagctatttggatgtggacttgcacccagcatcagcctggacattgtacgccgtggccacaacagtaatagcaccaatgttgagacataccatagagaattccacagcaaatgtgtcaatggcagctatagctaaccaggcagtggtcctgatgggtttggacaaaggatggccaatatcgaaaatggacttaggcgtaccactactggcattgggttgctatttttacgtgaacccactgactcttacagcggcagtatttttgctagtcacacattatgctattataggtccaggattgcaggcaaaagccactcgtgaagctcataaaaagacagctgctggaataatgaatcctccaccgggggatgggataatgacaatagacctagatcctgtaatatatgattcaaaatttgaaaagcaactgggacaggttatgctcctggttctgtgtgcagttcaacttttgttaatgagaacatcatgggccttgtgtgaagccttaaccctagccacaggaccaacaacaacactctgggaaggatcacctgggaagttttggaacaccacgatagctgtttctatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatccggaatcactgaagtggatagaacagaagccaaagaagggttgaaaagaggagaaataacacatcatgctgtgtccagaggtagcgcaaaacttcaatggttcgtggagagaaacatggtcattcccgaaggaagagtcatagacttaggctgtggaaaaggaggctggtcatattactgtgcaggactgaaaaaagttacagaagtgcgaggatacacaaaaggcggcccaggacacgaagaaccagtacctatgtctacatatggatggaacatagttaagttaatgagtggaaaggatgtgttttatcttccacctgaaaagtgtgataccctattgtgtgacattggagaatcttcaccaagcccaacagtggaagaaagcagaactataagagttttgaagatggttgaaccatggctaaaaaacaaccagttttgcattaaagtattgaacccttacatgccaactgtgattgagcacctagaaagactacaaaggaaacatggaggaatgcttgtgaggaatccactctcacgaaactccaggaacgaaatgtactggatatccaatggtacaggcaacatcgtctcttcagttaacatggtatccagattgctactgaacagattcacgatgacacacaggagacccaccatagagaaagatgtggatttaggagcaggaactcgacatgttaatgcggaaccagaaacacccaacatggatgtcattggggaaagaataaaaaggatcaaggaggagcataattcaacatggcactatgatgacgaaaatccttacaaaacgtgggcttaccatggatcctatgaagtcaaagccacaggctcagcctcctccatgataaatggagtcgtgaaactcctcactaaaccatgggatgtggtgcccatggtgacacagatggcaatgacagatacaaccccatttggccagcagagagtttttaaagagaaagtggacaccaggacacccaggctcatgcccaggacaagaaaggtaatggagatcacagcggagtggctctggagaaccctgggaaggaacaaaagacccagattatgcacaagggaagagttcacaaaaaaggtcagacccatcgcagccatgggcgccgttttcacacagagagaccaatgggacagtgcgaaagctgctgttgaggatgaagaattttggaaacctgtggacagagagtgtaactcccaccaattgggcaaatgtggaagctgcgtttacaacatgatgggcaagagagagaagaaacttggagagtttggcaaagcaaaaggcagtagagctatatggtacatgtggttgggagccaggtaccttgagttcgaagccctcggattcttaaatgaagaccactggttctcgcgtgaaaactcttacagtggagtagaaggagaaggactgcacaagctgggatacatattaagggacatttccaagatacccggaggagctatgtatgctgatgacacagctggttgggacacaaggaatacagaagatgacctgcacatgaaggaaaagatcacacagcaaatgggacctggacacagcaggttagcgaacgctatattcaagctcacataccaaaacaaggtggtcaaagttcaacgaccaactccaacgggcacggtaatggacatcatatctaggaaagaccaaagaggcagtggacaggtgggaacttatggtctaaatacattcaccaacatggaagcccagttagtcagacaaatggaaggagaaggtgtgctgtcaaaggcagacctcgagaaccctcatctgctagagaagaaaattacacaatggttggaaaccaaaggagtggagaggttaaaaagaatggccatcagcggagatgattgcgtagtgaaaccaatcgatgacaggttcgctaatgccctgcttgctctgaacgatatgggaaaggttaggaaggacatacctcaatggcagccatcaaagggatggcatgattggcaacaggttcctttctgctcccaccactttcatgaattgatcatgaaagatggaagaaagttggtggttccctgcagaccccaggatgaactaataggaagagcgagaatctctcaaggagcaggatggagccttagagaaactgcatgtctggggaaagcctacgcccaaatgtggagtctcatgtattttcacagaagagatctcagactagcatccaacgccatatgttcagcagtaccagtccattgggtccccacaagtagaacgacatggtctattcatgctcaccatcagtggatgactacagaagacatgcttactgtctggaacagggtgtggatagaggataatccatggatggaagacaaaactccagttacaacttgggaaaatgttccatatctagggaagagagaagaccaatggtgcggatcactcattggtctcacttccagagcaacctgggcccagaacatacccacagcaatccaacaggtgagaagccttataggcaatgaagagtttctggactacatgccttcgatgaagagattcaggaaggaggaggagtcagagggagccatttggtaa

SEQ ID NO: 7293 - RNA, 9873 nt, synthetic construct
  misc_feature 1..9873: note = derived and/or modified CDS sequence (wt) from DENV-3__GU131903__SS-prME
  source 1..9873: mol_type = other RNA
acatcgctctgtctcatgatgatgttaccagcaacacttgctttccacttgacttcacgcgatggagagccgcgaatgattgtggggaagaatgaaagagggaaatccttactatttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagccacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttgggggaacggttgtggtttgtttggaaaaggaagcttggtgacatgcgcgaaatttcaatgtctagaaccaatagagggaaaagtggtgcaacatgagaaccttaaatacactgtcatcatcacagtgcacacaggagaccaacaccaggtgggaaacgacacgcagggagtcacggttgagataacaccccaggcttcaaccgttgaagctgtcttgcctgagtatggaacccttgggctagaatgctcaccacggacaggcctggatttcaatgaaatgattttgttgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcagggcacttgaaatgtagacttaagatggacaaactggaactcaaggggatgagctatgcaatgtgcttgaatacctttgtgttgaagaaagaagtctctgaaacgcagcatgggacaatactcattaaggttgagtacaaaggggaagacgcaccttgcaagattcctttctccacagaggatggacaagggaaagcccacagtggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaatcatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactaacaccacagcccatggagctaaaatactcatggaaaacatggggaaaggcaaaaatagtgacagctgaaacacaaaattcctctttcataatagatgggccaaacacaccggagtgtccaaatgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgcacttggccaaaatcacacactctttggagcaatggtgtactagagagtgacatgatcatcccaaagagtctagctggtcctatttcacaacacaaccacaggcccgggtaccacacccagacggcaggaccttggcacttgggaaaactggagctggactttaattattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggatggctgctggtatggcatggaaattagacctatcaatgagaaagaagagaacatggtaaagtctctagtctcagcagggagtggaaaggtggacaacttcacaatgggagtcctgtgtttagcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgataggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagccagttctctccttaggaatgatgtgcccatggctggaccactagtggccgggggtttgttgatagcgtgctatgtcataactggcacgtcagcagacctcactgtagagaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgaacgcacaatggcaaaagggagaggaggtgcaggttattgccgtagagcctgggaagaacccaaaaaactttcaaaccatgccaggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacatttacaatgcgcttactatcgccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaatacaccagaagggatcataccagctctctttgaaccagagagggagaagtcagccgctatagacggtgaataccgcctgaagggtgagtccaggaagaccttcgtggaactcatgaggaggggtgacctcccagtttggctagctcataaagtagcctcagaagggatcaaatacacagatagaaaatggtgctttgatggagaacgcaataatcaaattttagaggagaacatggatgtggaaatctggacaaaggaaggagaaaggaaaaaactgagacctaggtggcttgatgcccgcacttattcagatcccctagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtccaaagaaccaggtgttgtttctccaaccagctatttagatgtagacttgcacccagcatcagcctggacattgtatgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccatcataggtccaggattgcaggccaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagccgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaagccggcccaggccacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatggcaactgggattgagcacctagaaagactacaaagaaaatatggaggaatgcttgtgagaaacccactctcacgaaactccacgcatgaaatggactggatatccaatggcaccggcaacatcgtctcttcagtcaacatggtatctagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttataaaacgtgggcttaccatggatcctatgaagtgaaagccacaggctcagcctcctccatgataaatggagtcgtgaaactcctcacaaaaccatgggatgtggttcccatggtgacacagatggcaatgacagacacaactccatttgggcagcaaagagtttttaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagccgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggatcctgaacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagccgaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttctagagcaacctgggcccagaacatactcacagcaatccaacaggtgagaagcctcataggcgatgaagaatttctggactacatgccttcgatgaagagattcaggaaggaggaggagtcagagggagccatttggtaa

SEQ ID NO: 7294 - RNA, 9873 nt, synthetic construct
  misc_feature 1..9873: note = derived and/or modified CDS sequence (wt) from DENV-3__GU131904__SS-prME
  source 1..9873: mol_type = other RNA
acatcgctctgtcttatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattatataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcattacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggcacaagcatttttgcggggcacttgaaatgtagacttaagatggacaaactggaactcaaggggatgagctatgcaatgtgcttgaatacctttgtgttgaagaaagaagtctccgaaacacagcatgggacaatactcattaaagttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggcgacagccatcgcaggcgcctgggaaaatggagtctgtggaatcaggtcaacaaccagaatggagaatctattgtggaagcaaatagccaatgagctgaactacatattatgggaaaacagcatcaaattaacggtagttgtgggcgacataattggggtcttagagcaagggaaaagaacactaacaccacagcccatggagctgaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccgaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgatcgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacatgttcaaacacaattttcacgttgactgttgcctggagaacagccaccttgattctggccggagtttcgctgttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctggctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaatagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagacgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgccatagacggtgaataccgcctgaagggtgagtccaggaagaccttcgtggaactcatgaggaggggtgacctcccagtttggctagcccacaaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagaccccttagcactcaaggaattcaaggattttgcagctggcagaaagtcaatcgcccttgatcttgtaacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgcttccagtggcatgttatggatggctgatgtcccactccaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacgaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagtcacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaaaaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgagaaaagttacagaagtgcgaggatacacaaaaggcggcccaggacacgaagaaccagtacctatgtccacatacggatggaacatagtcaagttaatgagtggaaaggacgtgttctatcttccacctgaaaagtgtgacaccctattgtgtgacattggagaatcttcaccaagcccaacagtggaagaaagcagaactataagagttttgaagatggttgagccgtggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacaatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactacgatgatgaaaatccttacaaaacgtgggcttaccatggatcctatgaagtcaaagccacaggctcagcctcctccatgataaatggagtcgtgaaactcctcacaaaaccatgggatgtggttcctatggtgacacagatggcaatgacagatacaactccatttgggcagcaaagagttttcaaagagaaagtggacaccaggacacccaggcccatggcagggacaagaaaggttatggagattacagcggaatggctttggagaaccctgggaaggaacaaaaaacccagattgtgcacaagggaagagttcacaaaaaaggtcagaaccaacgcggccatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttaggagccaggtaccttgagttcgaagcactcggatttttaaatgaagaccactggttctcacgtgaaaactcttacagtggagtagaaggagaaggactgcacaagctgggatacattttaagagacatttctaagatacccggaggagccatgtatgctgatgacacagctggctgggacacaagaataacagaggatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggtagtggacaggtggggacttatggtctgaacacattcaccaacatggaagcccagttagtcagacagatggaaggagaaggcgtgttgtcgaaggcagacctcgagaaccctcatctgctagagaagaaaatcacgcaatggttggaaaccaaaggagtggagagattaaaaagaatggccatcagcggggatgattgcgtggtgaaaccaatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctcactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7295 - RNA, 9873 nt, synthetic construct
  misc_feature 1..9873: note = derived and/or modified CDS sequence (wt) from DENV-3__GU131906__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacctatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatctttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaagaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggcgactgccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggatttttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacattgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccagaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagaccccgccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgaggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacatctagcccacagaacgagaaacgccctggacaacttggtgatgctgcatacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgcttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagtcacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttctgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaatatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccattcgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggggccaggtaccttgagttcgaagcactcggatttttaaatgaagaccactggttctcgcgtgaaaactcttacagtggggtagaaggagaaggactgcacaagttgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagggaagaaaatcacacaatggttggaaaccaaaggagtggagagattaaaaagaatggccatcagcggggatgattgcgtggtgaaaccgatcgatgacaggtttgccaatgccttgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccccacaagcagaacgacatggtctattcacgctcaccatcagtggatgactacagaagacatgcttactgtctggaacagggtgtggatagaggacaatccatggatggaagacaaaactccagtcacaacttgggaagatgttccatacctaggaaagagagaagatcaatggtgcggatcactcattggtctcacttccagagcaacctgggcccagaacatactcacagcaatccaacaggtgagaagccttataggcgatgaagaatttctggactacatgccttcgatgaagagatttaggaaggaggaggagtcagagggagccatttggtaa

SEQ ID NO: 7296 - RNA, 9873 nt, synthetic construct
  misc_feature 1..9873: note = derived and/or modified CDS sequence (wt) from DENV-3__GU131907__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaacctcacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgaaaacctcaaatacactgtcatcatcacagtgcacacaggagaccaacaccaggtgggaaatgacacgcagggagtcacagttgagataacaccccaggcatcaaccgttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgctcatgcaaaaaagcaagaagtggttgtccttggatcgcaagagggagcaatgcacacagcgctgacaggagctacagagattcaaaactcaggaggtacaagcatttttgcggggcatttgaaatgtagactcaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaaatggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtcctatttcacaacacaaccataggcccgggtaccacacccaaacggcaggaccttggcacttgggaaaattggagctggactttaactattgtgaaggaacaacagtagtcatcgcagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaactgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactaataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcatcctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtttcaggcatctttccatactccatacccgccacactgttggtctggcacacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtggtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggaaaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaaccacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaggaagggttgaaaagaggagaaacaacacatcatgctgtgtccagaggcagcgcaaaacttcaatggttcgtggagaggaacatggtcattcccgaaggaagagtcatagacctgggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttctatcttccacctgaaaagtgtgacaccctattgtgtgacattggagaatcttcaccaagcccaacagtggaagaaagcagaactataagagttttgaagatggttgagccatggttaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggtgatgaagaatttctggactacatgccttcgatgaagagattcaggaaggaggaggagacagagggagccatttggtaa

SEQ ID NO: 7297 - RNA, 9873 nt, synthetic construct
  misc_feature 1..9873: note = derived and/or modified CDS sequence (wt) from DENV-3__GQ868634__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcatcgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgtgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcttcaaccgttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttaggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagagaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccgtactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgaacgcacaatggcaaaagggagaagaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttggcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagataaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaaacaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaaccagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcccatggtgacacagatggcaatgacggatacaactccatttgggcagcaaagagtttttaaagagaaagtggacaccaggacacccaggcccatgccagggacaagaaaggttatggagattacagcggaatggctttggagaaccctgggaaggaacaaaaaacccagattgtgcacaagagaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgatctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcacctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgactggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7298 - RNA, 9873 nt, synthetic construct
  misc_feature 1..9873: note = derived and/or modified CDS sequence (wt) from DENV-3__GU131908__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcatcgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgtgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcttcaaccgttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacttggacagagcaatacaaatttcaagcagactcccccaaaagactggcgacagccatcgcaggcgcttggaaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttaggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagagaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccgtactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgaacgcacaatggcaaaagggagaagaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttggcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagataaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaaacaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaaccagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcccatggtgacacagatggcaatgacggatacaactccatttgggcagcaaagagtttttaaagagaaagtggacaccaggacacccaggcccatgccagggacaagaaaggttatggagattacagcggaatggctttggagaaccctgggaaggaacaaaaaacccagattgtgcacaagagaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgatctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgactggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7299 - RNA, 9873 nt, synthetic construct
  misc_feature 1..9873: note = derived and/or modified CDS sequence (wt) from DENV-3__GU131909__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggcttttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcatcgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgtgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcttcaaccgttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttaggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagagaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccgtactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgaacgcacaatggcaaaagggagaagaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttggcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagataaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaaacaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaaccagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcccatggtgacacagatggcaatgacggatacaactccatttgggcagcaaagagtttttaaagagaaagtggacaccaggacacccaggcccatgccagggacaagaaaggttatggagattacagcggaatggctttggagaaccctgggaaggaacaaaaaacccagattgtgcacaagagaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgatctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcacctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgactggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7300 - RNA, 9873 nt, synthetic construct
  misc_feature 1..9873: note = derived and/or modified CDS sequence (wt) from DENV-3__GU131912__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagctgtcttgcccgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaaacatttttgcggggcatttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctatcaacattgaggctgaacctccttttggggaaagcaacatagtgattggaattggagacaaagccttgaaaattaactggtacaagaagggaagctcgattgggaagatgttcgaggcgactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaggctgacatggggtgcgtcataaactggaaaggaaaagaactcaaatgtggaaatggaatttttgtcactaatgaggtccacacttggacagagcaatacaaatttcaagcagactcccccaaaagactggcgacagccatcgcaggctcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtcctatttcacaacacaaccataggcccgggtaccacacccaaacggcaggaccttggcacttgggaaaattggagctggactttaactattgtgaaggaacaacagtagtcatcgcagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctctttaacatgttcaaacacaattttcacgttgactgttgcctggagaacagccacgttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaagagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacgacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccaacaccggaattggaagaagaaatgttcaaaaagcgaaatctaactataatggatcttcatcctgggtcaggaaagacgcggaaatatcttccagctatcgtcagagaggcaatcaagagacgcctaagaactctaattttggcaccaacaagagtggttgcagctgagatggaagaagcactgaaaggactcccaataaggtatcaaacaactgcatcaaaatctgaacacacaggaagggagattgttgatctaatgtgccacgcaacattcacaatgcgcttactatcaccagtcagggttccaaattataatttgataataatggatgaggcccatttcacagacccagccagtatagcggctagagggtatatatcaactcgtgtaggaatgggagaggcagctgcaattttcatgacagcaacaccccctggaactgctgaagcttttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcaagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggccgcgatagtagcagctaatgaaatgggattattggaaaccacaaagagagatctaggaatgtctaaagaaccaggtgttgtttctccaaccagctatttagatgtagacttgcacccagcatcagcctggacattgtacgccgtggccacaacagtgataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatctacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagagaagtggaaaaagaaattaaatcagttgtcccggaaagagtttgacctttacaagaaatctggaatcactgaagtggatagaacagaagccaaagaagggttgaaaagaggagaaacaacacatcatgctgtgtccagaggcagcgcaaaacttcaatggttcgtggagaggaacatggtcattcccgaaggaagagtcatagacttaggctgtggaagaggaggctggtcatattattgcgctggactgaaaaaagttacagaagtgcgagggtacacaaaaggcggcccaggacacgaagaaccagtacctatgtctacatacggatggaacatagtcaagttaatgagtggaaaggacgtgttctatcttccacctgaaaagtgtgacaccctattgtgtgacattggagaatcttcaccaagcccaacagtggaagaaagcagaactataagagttttgaggatggttgagccatggctaagaaacaaccagttttgcattaaagtattaaacccttacatgccaaatgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatctgggagcgggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagacacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatattcaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcggaggcagacctcgagaaccctcatctgctagagaagaaaatcacacaatggttggaaaccaaaggagtggagagattaaaaagaatggctatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggctcagaacatactcacagcaattcaacaggtgagaagccttataggcgatgaagaattcctggactacatgccttcgatgaagagattcaggaaggaggaggagtcagagggagccatttggtaa

SEQ ID NO: 7301 - RNA, 9873 nt, synthetic construct
  misc_feature 1..9873: note = derived and/or modified CDS sequence (wt) from DENV-3__GU131913__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacctccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcagggcatttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctatcaacattgaggctgaacctccttttggggaaagcaacatagtgattggaattggagacaaagccttgaaaattaactggtacaagaagggaagctcgattgggaagatgttcgaggctactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattgtcacactctatctgggagccgtggtacaggctgacatggggtgcgtcataaactggaaaggaaaagaactcaaatgtggaaatggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagctaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgcacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgatatgatcatcccaaagagtctagctggtcctatttcacaacacaaccataggcccgggtaccacacccaaacggcaggaccttggcacttgggaaaattggagctggactttaactattgtgaaggaacaacagtagtcatcgcagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaattgccagaggacattgaacaaatggcgaatggaattgctctggggctcatgactctaaaactgataacacaatttgagacatatcagttgtggacggcattagtctctttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaagagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacgacaacgggggaaataggagcaattgcactagacttcaagcctggaacttcaggatctcctatcataaacagagagggaaaggtagtggggctgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcttttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggttatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtatatattcacgggccagcctctcaacaatgacgaagaccatgcccactggacagaagcaaaaatgctgctagacaacattaacacaccagaagggatcataccagctctctttgaaccagagagagagaagtcagccgctatagacggtgaataccgcctgaagggcgagtccaggaagaccttcgtggaactcatgaggaggggtgacctcccagtttggctagcccataaagtagcctcagaagggatcaaatacacagatagaaaatggtgctttgatggagaacgaaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggtggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaatcaactcgcatatgtcgtgataggcatacttacactggctgcgatagtagcagctaatgaaatgggattattggaaaccacaaagagagatctaggaatgtctaaagaaccaggtgttgtttctccaaccagctatttagatgtagacttgcacccagcatcagcttggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatctacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgctgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgagggtacacaaaaggcggcccaggacacgaagaaccagtacctatgtctacatacggatggaacatagtcaagttaatgagtggaaaggatgtgttctatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaaatgtaattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatctgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggtcatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaacatgatgggcaagagagagaagaaacttggagagtttggcaaagcaaaaggcagtagagccatatggtacatgtggttgggagccaggttccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggcctgaacacattcaccaacatggaagcccagttagtcagacagatggaaggagaaggcgtgttgtcggaggcagacctcgagaaccctcatctgctagagaagaaaatcacacaatggttggaaaccaaaggagtggagagattaaaaagaatggccatcagcggggatgattgcgtggtaaaaccgatcgatgacaggtttgctaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaacagcatgtctagggaaagcttacgctcaaatgtggagtctcatgtattttcacagaagagatcttagactagcatccaacgccatttgttcagcagtaccagtccattggatccctacaagcagaacgacatggtctattcatgctcaccatcagtggatgaccacagaagacatgcttactgtctggaacagggtgtggatagaggacaatccatggatgggagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaattcctggactacatgccttcgatgaagagattcaggaaggaggaggagtcagagggagccatttggtaa

SEQ ID NO: 7302 - RNA, 9873 nt, synthetic construct
  misc_feature 1..9873: note = derived and/or modified CDS sequence (wt) from DENV-3__GU131914__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacctccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcagggcatttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctatcaacattgaggctgaacctccttttggggaaagcaacatagtgattggaattggagacaaagccttgaaaattaactggtacaagaagggaagctcgattgggaagatgttcgaggctactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaggctgacatggggtgcgtcataaactggaaaggaaaagaactcaaatgtggaaatggaatttttgtcaccaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagctaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgcacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgatatgatcatcccaaagagtctagctggtcctatttcacaacacaaccataggcccgggtaccacacccaaacggcaggaccttggcacttgggaaaattggagctggactttaactattgtgaaggaacaacagtagtcatcgcagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaattgccagaggacattgaacaaatggcgaatggaattgctctggggctcatgactctaaaactgataacacaatttgagacatatcagttgtggacggcattagtctctttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaagagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacgacaacgggggaaataggagcaattgcactagacttcaagcctggaacttcaggatctcctatcataaacagagagggaaaggtagtggggctgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcttttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggttatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagagagaagtcagccgctatagacggtgaataccgcctgaagggcgagtccaggaagaccttcgtggaactcatgaggaggggtgacctcccagtttggctagcccataaagtagcctcagaagggatcaaatacacagatagaaaatggtgctttgatggagaacgaaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggtggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaatcaactcgcatatgtcgtgataggcatacttacactggctgcgatagtagcagctaatgaaatgggattattggaaaccacaaagagagatctaggaatgtctaaagaaccaggtgttgtttctccaaccagctatttagatgtagacttgcacccagcatcagcttggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccatcataggtccaggattgcaggctaaagccactcgtgaagctcaaaaaagaacagctgctggaataatgaagaatccaacggtggacgggataatgacaatagacctagatcctgtaatctacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgctgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgagggtacacaaaaggcggcccaggacacgaagaaccagtacctatgtctacatacggatggaacatagtcaagttaatgagtggaaaggatgtgttctatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaaatgtaattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatctgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggtcatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaacatgatgggcaagagagagaagaaacttggagagtttggcaaagcaaaaggcagtagagccatatggtacatgtggttgggagccaggttccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggcctgaacacattcaccaacatggaagcccagttagtcagacagatggaaggagaaggcgtgttgtcggaggcagacctcgagaaccctcatctgctagagaagaaaatcacacaatggttggaaaccaaaggagtggagagattaaaaagaatggccatcagcggggatgattgcgtggtaaaaccgatcgatgacaggtttgctaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaacagcatgtctagggaaagcttacgctcaaatgtggagtctcatgtattttcacagaagagatcttagactagcatccaacgccatttgttcagcagtaccagtccattggatccctacaagcagaacgacatggtctattcatgctcaccatcagtggatgaccacagaagacatgcttactgtctggaacagggtgtggatagaggacaatccatggatgggagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaattcctggactacatgccttcgatgaagagattcaggaaggaggaggagtcagagggagccatttggtaa

SEQ ID NO: 7303 - RNA, 9873 nt, synthetic construct
  misc_feature 1..9873: note = derived and/or modified CDS sequence (wt) from DENV-3__GU131915__SS-prME
  source 1..9873: mol_type = other RNA
acatcgctctgtctcatgatgatgttaccagcaacacttgctttccacttgacttcacgcgatggagagccgcgaatgattgtggggaagaatgaaagagggaaatccttactttttaagacagcttctggaatcaacatgtgcactctcatagctatggacttgggagagatgtgtgatgacacggtcacttataaatgccccctcattgctgaagcggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgttggttactccatccatgacaatgagatgcgtgggagtaggaaacagagattttgtggaaggtctgtcaggagccacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaacatgagaaccttaaatacactgtcatcatcacagtgcacacaggagaccaacaccaggtgggaaacgacacgcagggagtcacggttgagataacaccccaggcttcaaccgttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcagggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagacgcaccttgcaagattcctttctccacagaggatggacaagggaaagcccacagtggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaatcatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgattatcccaaagagtctagctggtcctatttcacaacacaaccacaggcccgggtaccacacccagacggcaggaccttggcacttgggaaaactggagctggactttaattattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttagcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgataggatgggaatgggcgttacctatttagctttaattgcaacattcaaaatccaaccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattctggccggagtttcgcttttgccactgtgccagtcttcgagtatgaggaaaacagattggcttccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagagaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgaacgcacaatggcaaaagggagaggaggtgcaggttattgccgtagagcctgggaagaacccaaaaaactttcaaaccatgccaggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcgccagtcagggttccaaattacaatttggtaataatggacgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagctggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccattggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagctcataaagtagcctcagaagggatcaaatacacagatagaaaatggtgctttgatggagaacgcaacaatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgcccttgacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtccaaagaaccaggtgttgtttctccaaccagctatttagatgtagacttgcacccagcatcagcctggacattgtatgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccatcataggtccaggattgcaggccaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaactacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggcaccggcaacatcgtctcttcagtcaacatggtatctagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttataaaacgtgggcttaccatggatcctatgaagtgaaagccacaggctcagcctcctccatgataaatggagtcgtgaaactcctcacaaaaccatgggatgtggttcccatggtgacacagatggcaatgacagacacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagccgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggatcctgaacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgtggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7304 - RNA, 9873 nt, synthetic construct
  misc_feature 1..9873: note = derived and/or modified CDS sequence (wt) from DENV-3__GU131916__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattatgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtatcacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctcctcctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaattcgagacatatcagttgtggacggcattagtctccttaacatgttctaacacaattttcacgttgactgttgcctggagaacagccaccttgattttggccggagtttcgcttttgccactgtgccagtcttcgagcatgaggaaaacagattggctcccaatgactgtggcagctatgggagtcccacccttaccactttttatcttcagcttgaaggacacacccaagaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcctaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggtcattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtgattacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcttgcggaaaaatgggaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgccctcgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttactaacaagtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactagctgcgatagtagcagctaatgaaatgggattattggaaactacaaagagagatctaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtacctctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacagtggacgggataatgacaatagacctagatcctgtaatatacgattcaaaattcgaaaagcaactaggacaggtcatgctcttggttctgtgtgcagttcaacttttgttaatgagaacatcatgggccttgtgcgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtcaacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaaggataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagagaagagtttacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctacataatgaggaaaaaatcacacagcaaatggaccctgaacacagacaattagcgaacgccatatttaagctcacataccaaaacaaggtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaagacgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccacttccatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaattttcggactacatgccttcgatgaagagattcaggaaggaggaggagtcagagggagccatttggtaa

SEQ ID NO: 7305 - RNA, 9873 nt, synthetic construct
  misc_feature 1..9873: note = derived and/or modified CDS sequence (wt) from DENV-3__GU131917__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaaccagaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttacactactaatgctggtcactccatccatgacaatgagatgcgtgggagtaggaaacagagattttgtggaaggtctgtcaggagctacgtgggttgatgtggtgctcgagcacggtgggtgcgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggacagaggttggggaaacggttgtggtttgtttggaaaaggaagcttggtgacatgcgcgaaatttcagtgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcatttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccaccgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagctgtggtacaagctgacatggggtgcgtcataaactggaaaggaaaagaactcaaatgtggaaatggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtcctatttcacaacacaaccataggcccgggtaccacacccaaacggcaggaccttggcacctgggaaaattggagctggactttaactattgtgaaggaacaacagtagtcatcgcagaaaactgtgggacaagaggcccatcattgagaacaacaacagtatcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaagttgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacctagccccccagaaacacagaaagcagaactggaagagggggtctataggatcaaacaacaaggaatttttgggaaaacccaagtgggggttggagtgcagaaagaaggagttttccataccatgtggcacgtcacaagaggagcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggacattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcccctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacatcagaacatggcggtagggcctacaggcatgcagtagaggaactaccagaaacaatggaaacactcctactcttgggactcatgattttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaattttttatgatggtgttgctcataccagaaccagaaaaacaaagaactccccaagacaaccaactcgcatatgtcgtgataggcatacttacactggctgcgatagtagcagctaatgaaatgggattattggaaaccacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaattaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaagagaggaacggggtcacaaggcgaaaccttaggagagaagtggaaaaagaaattaaatcagttatcccggaaagagtttgacctttacaagaaatctggaatcactgaagtggatagatcagaagccaaagaagggttgaaaagaggagaaacaacacatcatgctgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttctatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtcttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaatatgatgggcaagagagagaaaaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttccaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcatacaatggttggaaaccaaaggagtggagagattaaaaagaatggccatcagcggggatgattgcgtggtgaaaccgatcgatgacaggtttgccaatgccctgcttgccttgaacgacatgggaaaggtcaggaaggacataccccaatggcagccatcaaaggggtggcatgattggcaacaggtccctttctgctcccaccactttcatgaactgatcatgaaagatggaagaaagctggtggttccctgcagaccccaggacgaactaataggaagggcgagaatctctcaaggagcaggatggagccttaaagaaactgcatgcctagggaaagcttacgctcaaatgtggagtctcatgtattttcacaggagagatcttagactagcatccaacgccatttgttcagcagtaccagtccattggatccctacaagcagaacgacatggtctattcacgctcaccatcagtggatgactacagaagacatgctttctgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7306 - RNA, 9873 nt, synthetic construct
  misc_feature 1..9873: note = derived and/or modified CDS sequence (wt) from DENV-3__GU131918__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaaccagaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgcgtgaccaccatggctaagagcaagcctacgctggacatagagcttcagaagactgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggacagaggttggggaaacggttgtggtttgtttggaaaaggaagcttggtgacatgcgcgaaatttcagtgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcatttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccctgcaaaattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccaccgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgttctcttaacctggatagggttgaattcaaaaaacacttccatgtcattttcatgcattgtgataggaattatcacactctatctgggagccgtggtgcaagctgacatggggtgcgtcataaactggaaaggaaaagaactcaaatgtggaaatggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggactttaactattgtgaaggaacaacagtagtcatcacagaaaactgtgggacaagaggcccatcattgagaacaacaacagtatcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctggctagttctctccttaggaatgatgtgcctatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacctagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcccctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaaccacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagatcagaagccaaagaagggttgaaaagaggagaaacaacacatcatgctgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttctatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtcttcaaagagaaagtggacaccaggacacccaggcccatgccagggacaagaaaggttatggagattacagcggaatggctttggagaaccctgggaaggaacaaaaaacccagactgtgcacaagggaagagttcacaaaaaaggtcagaaccaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaatatgatgggcaagagagagaaaaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcatacaatggttggaaaccaaaggagtggagagattaaaaagaatggccatcagcggggatgattgcgtggtgaaaccgatcgatgacaggtttgccaatgccctgcttgccttgaacgacatgggaaaggtcaggaaggacataccccaatggcagccatcaaaggggtggcatgattggcaacaggtccctttctgctcccaccactttcatgaactgatcatgaaagatggaagaaagctggtggttccctgcagaccccaggacgaactaataggaagggcgagaatctctcaaggagcaggatggagccttaaagaaactgcatgcctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctttctgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7307 - RNA, 9873 nt, synthetic construct
  misc_feature 1..9873: note = derived and/or modified CDS sequence (wt) from DENV-3__GU131933__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattatataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggctacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcattacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggcacaagcatttttgcggggcacttgaaatgtagacttaagatggacaaactggaactcaaggggatgagctatgcaatgtgcttgaatacctttgtgttgaagaaagaagtctccgaaacacagcatgggacaatactcattaaagttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacagcatcaaattaacggtagttgtgggcgacataattggggtcttagagcaagggaaaagaacactaacaccacagcccatggagctgaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaaactagaaaaagcatccttcatagaggtgaaaacctgtacttggccgaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgatcgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacatgttcaaacacaattttcacgttgactgttgcctggagaacagccaccttgattctggccggagtttcgctgttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctggctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaatgggggaaataggagcaattgcactagacttcaagcctggaacttcaggatctcctatcataaatagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaagaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgatcagtacatattcacgggccagcctctcaacaatgacgaagaccatgcccactggacagaagcaaaaatgctgctagacaacattaacacaccagaagggatcataccagctctctttgaaccagagagggagaagtcagccgccatagacggtgaataccgcctgaagggtgagtccaggaagaccttcgtggaactcatgaggaggggtgacctcccagtttggctagcccacaaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagaccccttagcactcaaggaattcaaggattttgcagctggcagaaagtcaatcgcccttgatcttgtaacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgcttccagtggcatgttatggatggctgatgtcccactccaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacgaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagtcacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtccacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccgtggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacaatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactacgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagacacaactccatttgggcagcaaagagttttcaaagagaaagtggacaccaggacacccaggcccatggcagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttaggagccaggtaccttgagttcgaagcactcggatttttaaatgaagaccactggttctcacgtgaaaactcttacagtggagtagaaggagaaggactgcacaagctgggatacattttaagagacatttctaagatacccggaggagccatgtatgctgatgacacagctggctgggacacaagaataacagaggatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggtagtggacaggtggggacttatggtctgaacacattcaccaacatggaagcccagttagtcagacagatggaaggagaaggcgtgttgtcgaaggcagacctcgagaaccctcatctgctagagaagaaaatcacgcaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctcactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7308 - RNA, 9873 nt, synthetic construct
  misc_feature 1..9873: note = derived and/or modified CDS sequence (wt) from DENV-3__GU131934__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcctctggaatcaacatgtgcactctcatagctatggacttgggagagatgtgtgatgacacggtcacttataaatgccccctcattgctgaagtggaacctgaagacattgactgctggtgcaacctcacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtggattgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgaaaaccttaaatacactgttatcatcacagtgcacacaggagaccaacaccaggtgggaaatgacacgcagggagtcacagttgagataacaccccaggcatcaaccgttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgctcatgcaaaaaagcaagaagtggttgtccttggatcgcaagagggagcaatgcacacagcgctgacaggagctacagagattcaaaactcaggaggtacaagcatttttgcggggcatttgaaatgtagactcaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggagttatcacactctatctgggagccgtggtacaagctgacatggggtgcgtcataaactggaaaggaaaagaactcaaatgtggaaatggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaaaccaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtcctatttcacaacacaaccataggcccgggtaccacacccaaacggcaggaccttggcacttgggaaaattggagctggactttaactattgtgaaggaacaacagtagtcatcgcagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactaataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcatcctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtttcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagtgtgaaaaaagatctgatttcatacggaggaggatggagattgagcgcacaatggcaaaagggagaggaggtgcaggttattgccgtagagcctgggaagaacccaaaaaactttcaaaccatcccgggcatttttcagacaacaacgggggaaataggagcaattgcactagacttcaagcctggaacttcaggatctcctatcataaacagagagggaaaggtggtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcagctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagacagaaaatggtgctttgatggagaacgtaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaaccacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacagtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaggaagggttgaaaagaggagaaacaacacatcatgctgtgtccagaggcagcgcaaaacttcaatggttcgtggagaggaacatggtcattcccgaaggaagagtcatagacctaggctgtggaagaggaggctggtcatattattgcgcaggactgaaaaaagttacagaagtgcgaggatacacaaaaggcggcccaggacacgaagaaccagtacccatgtctacatacggatggaacatagtcaagttaatgagtggaaaggacgtgttctatcttccacctgaaaagtgtgacaccctattgtgtgacattggagaatcttcaccaagcccaacagtggaagaaagcagaactataagagttttgaagatggttgagccatggttaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggtgatgaagaatttctggactacatgccttcgatgaagagattcaggaaggaggaggagacagagggagccatttggtaa

SEQ ID NO: 7309 - RNA, 9873 nt, synthetic construct
  misc_feature 1..9873: note = derived and/or modified CDS sequence (wt) from DENV-3__GU131935__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgtcccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttctctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcaactctacctgaggagcaggaccagaactacgtatgtaagcacacatacgtggatagaggttggggaaacggttgtggtttgtttggaaaaggaagcttggtgacatgtgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcttcaaccgttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaagattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacggctttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttaggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagagaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccgtactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgaacgcacaatggcaaaagggagaagaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaaccgcaacaaaatctgaacacacaggaagggagattgttgatttaatgtgccacgcaacattcacaatgcgcttactatcaccagtcagggttccaaactacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttggcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagtaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagataaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaaacaactaggacaggtcatgctcttggttctgtgtacagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagccgggcttgctttttctatcatgaaatcagttggaacaggaaggagaggaacggggtcacaaggcgaaaccttaggagaaaagtggaaaaagaaattaaaccagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggttggtcatattattgcgcaggactgaaaaaagttacagaagtgcgaggatacacaaaaggcggcccaggacacgaagaaccagtacctatgtctacatacggatggaacatagtcaagttaatgagtggaaaagacgtgttttatcttccacctgaaaagtgtgacaccctattgtgtgacattggagaatcttcaccaagcccaacagtggaagaaagcagaactataagagttttgaagatggttgagccatggctaagaaacaaccagttttgtattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagattcacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtttttaaagagaaagtggacaccaggacacccaggcccatgccagggacaagaaaggttatggagattacagcggaatggctttggagaactctgggaaggaacaaaaaacccagattgtgcacaagagaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgatctgcacaatgaggaaaaaatcacacagcaaatggaccctgaacacagacaattagcgaacgccatattcaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgactggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcaatgaagaatttctggactacatgccttcgatgaagagattcaggaaggaggaggagtcagagggagccatttggtaa

SEQ ID NO: 7310 - RNA, 9873 nt, synthetic construct
  misc_feature 1..9873: note = derived and/or modified CDS sequence (wt) from DENV-3__GU131936__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaacctcacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgcgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtgtgtaagcacacatacgtggatagaggttggggaaacggttgtggtttgtttggaaaaggaagcttggtgacatgcgcgaaatttcagtgtctagaatcaatagagggaaaagtggtgcaatatgaaaaccttaaatacactgtcatcatcacagtgcacacaggagaccaacaccaggtgggaaatgacacgcagggagtcacagttgagataacacctcaggcatcaacagttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttctcgtaacattcaaaaatgctcatgcaaaaaagcaagaagtggttgtccttggatcgcaagagggagcaatgcacacagcgctgacaggagctacagagattcaaaactcaggaggtacaagcatttttgcggggcatttgaaatgtagactcaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaaatggaatttttgtcactaatgaggtccacacttggacagagcaatataaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagagcactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtcctatttcacaacacaaccataggcccgggtaccacacccaaacggcaggaccttggcacttgggaaaattggagctggactttaactattgtgaaggaacaacagtagtcatcgcagaaaactgtgggacaagaggcccatcattgagaacaacaacagtgtcagggaagctgatacacgaatggtgttgccgctcgtgcacacttcctcccttgcgatacatgggagaggacggctgctggtatggtatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactaataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcatcctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgaaaataaaggatgatgagactgagaacatcctaacagtgctcttaaaaacagcattactaatagtttcaggcatctttccatactccatacccgccacattgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtggtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcatgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctagatggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaaccacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaggaagggttgaaaagaggagaaacaacacatcatgctgtgtccagaggcagcgcaaaacttcaatggttcgtggagaggaacatggtcattcccgaaggaagagtcatagacctaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaagacgtgttctatcttccacctgaaaagtgtgacaccctattgtgtgacattggagaatcttcaccaagcccaacagtggaagaaagcagaactataagagttttgaagatggttgagccatggttaagaagcaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggcaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacctaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttatagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggtgatgaagaatttctggactacatgccttcgatgaagagattcaggaaggaggaggagacagagggagccatttggtaa

SEQ ID NO: 7311 - RNA, 9873 nt, synthetic construct
  misc_feature 1..9873: note = derived and/or modified CDS sequence (wt) from DENV-3__GU131937__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtagggaacagagattttgtggaaggtctgtcaggagctacgtgggttgatgtggtgctcgagcacggtgggtgtgtgaccaccatggctaagagcaagcctacgttggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagccgtcttgcctgagtatggaacccttgggctagaatgctcaccacggacgggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaacgcacatgcaaaaaagcaagaagtggttgtccttggatcgcaagagggagcaatgcacacagcgctaacaggagctacagagattcaaaactcaggaggtacaagcatttttgcggggcacttgaaatgtagacttaagatggacaaactggaactcaaggggatgagctatgcaatgtgcttgaacacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattggtaagatgttcgaggccactgctagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattgtgggaaaacaacatcaaattaacggtagttgtgggcgacataattggggtcttagagcaagggaaaagaacattaacaccacagcccatggagctaaaatattcatggaaaacatggggaaaggcaaaaatagtgacagctgaaacacaaaattcctccttcataatagatgggccaaacacaccggagtgtccaagtaccttaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaactacaggcccgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctcctcctctcaggacaaataacatggagagatatggcacacacactcataatgattgggtccaacgcctccgacaggatgggaatgggtgttacctatttagctttaattgcaacattcaaaatccagccattcttggccttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattttggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggtcattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgactgcaacaccccctggaactgctgaagcctttccccagagcaacgctccaattcaagatgaagaaagggacattccggaacgctcatggaattcaggcaatgaatggattaccgactttgttgggaagacggtgtggtttgtccctagcatcaaagccggaaatgacatagcaaactgcttgcggaaaaatggaaaaaaggtcatccaacttagtaggaagacttttgatacagaatatcaaaagaccagactgaatgattgggacttcgtggtgacaacagacatttcagaaatgggagctaacttcaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaatccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgccctcgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatctcactaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaaacagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagactgctactgaacagatttacgatgacacacaggagacccaccatagagaaagatgtggatttgggagcaggaactcgacatgtcaatgcggaaccagaaacacccaacatggacgtcattggagaaaggataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttggacagcaaagagttttcaaagagaaagtggacaccaggacacccaggcctatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgggaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaggtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgacgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7312 - RNA, 9873 nt, synthetic construct
  misc_feature 1..9873: note = derived and/or modified CDS sequence (wt) from DENV-3__GU131938__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaacctcacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgcgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaatcaatagagggaaaagtggtgcaatatgaaaaccttaaatacactgtcatcatcacagtgcacacaggagaccaacaccaggtgggaaatgacacgcagggagtcacagttgagataacacctcaggcatcaacagttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttctcgtaacattcaaaaatgctcatgcaaaaaagcaagaagtggttgtccttggatcgcaagagggagcaatgcacacagcgctgacaggagctacagagattcaaaactcaggaggtacaagcatttttgcggggcatttgaaatgtagactcaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaaatggaatttttgtcactaatgaggtccacacttggacagagcaatataaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagagcactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtcctatttcacaacacaaccataggcccgggtaccacacccaaacggcaggaccttggcacttgggaaaattggagctggactttaactattgtgaaggaacaacagtagtcatcgcagaaaactgtgggacaagaggcccatcattgagaacaacaacagtgtcagggaagctgatacacgaatggtgttgccgctcgtgcacacttcctcccttgcgatacatgggagaggacggctgctggtatggtatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactaataacacaatttgagacatatcagttgtggacggcattagtctccttaacatgttcaaacacaattttcacgttgactgttgcctggagaacagccaccttgattctggccggagtttcgcttttgccactgtgccagtcttcgagtatgaggaaaacagattggctcccaatgactgtggcagctatgggagtcccacccttaccactttttatcttcagcttgaaggacacacccaaaaggaggagctggccactgaatgagggagtgatggctgttgggcttgtgagcatcctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgaaaataaaggatgatgagactgagaacatcctaacagtgctcttaaaaacagcattactaatagtttcaggcatctttccatactccatacccgccacattgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtggtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcatgggccagcctctcaacaatgacgaagaccatgcccactggacagaagcaaaaatgctgctagacaacattaacacaccagaagcgatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctagatggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagttctggaatttttcatgatggtgttgctcataccagaaccagaaaaacaaagaactccccaagacaaccaactcgcatatgtcgtgataggcatacttacactggctgcgatagtagcagctaatgaaatgggattattggaaaccacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaggaagggttgaaaagaggagaaacaacacatcatgctgtgtccagaggcagcgcaaaacttcaatggttcgtggagaggaacatggtcattcccgaaggaagagtcatagacctaggctgtggaagaggaggctggtcatattattgcgcaggactgaaaaaagttacagaagtgcgaggatacacgaaaggcggcccaggacacgaagaaccagtacctatgtctacatacggatggaacatagtcaagttaatgagtggaaaagacgtgttctatcttccacctgaaaagtgtgacaccctattgtgtgacattggagaatcttcaccaagcccaacagtggaagaaagcagaactataagagttttgaagatggttgagccatggttaagaagcaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggcaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacctaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttatagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggtgatgaagaatttctggactacatgccttcgatgaagagattcaggaaggaggaggagacagagggagccatttggtaa

SEQ ID NO: 7313 - RNA, 9873 nt, synthetic construct
  misc_feature 1..9873: note = derived and/or modified CDS sequence (wt) from DENV-3__GU131939__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccaaaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcccacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagctgtcttgcccgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcatttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctatcaacattgaggctgaacctccttttggggaaagcaacatagtgattggaattggagacaaagccttgaaaattaactggtacaagaagggaagctcgattgggaagatgttcgaggctactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaggctgacatggggtgcgtcataaactggaaaggaaaagaactcaaatgtggaaatggaatttttgtcactaatgaggtccacacttggacagagcagtacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcttctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcgcacactctttggagcaatggtgtactagagagtgacatgatcatcccaaagagtctagctggtcctatttcacaacacaaccataggcccgggtaccacacccaaacggcaggaccttggcacttgggaaaattggagctggactttaactattgtgaaggaacaacagtagtcatcgcagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtccttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctctttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaagagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttagtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacgacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccaacaccggaattggaagaagaaatgttcaaaaagcgaaatctaactataatggatcttcatcctgggtcaggaaagacgcggaaatatcttccagctatcgtcagagaagcaatcaagagacgtctaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcctactatcaccagtcagggttccaaattacaatttgataataatggatgaggcccatttcacagacccagccagtatagcggctagagggtacatatcaactcgtgtaggaatgggagaggcagctgcaattttcatgacagcaacaccccctggaactgctgaagcttttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaagggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggagatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggccgcgatagtagcagctaatgaaatgggattattggaaaccacaaagagagatctaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatctacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgctgtgtccagaggcagcgcaaaacttcaatggttcgtggagaggaacatggtcattcccgaaggaagagtcatagacttaggctgtggaagaggaggctggtcatattattgcgctggactgaaaaaagttacagaagtgcgagggtacacaaaaggcggcccaggacacgaagaaccagtacctatgtctacatacggatggaacatagtcaagttaatgagtggaaaggacgtgttctatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaaatgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatctgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagacacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaactaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcggaggcagacctcgagaaccctcatctgctagagaagaaaatcacacaatggttggaaaccaaaggagtggagagattaaaaagaatggctatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaattcctggactacatgccttcgatgaagagattcaggaaggaggaggagtcagagggagccatttggtaa

SEQ ID NO: 7314 - RNA, 9873 nt, synthetic construct
  misc_feature 1..9873: note = derived and/or modified CDS sequence (wt) from DENV-3__GU131940__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcatcgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgtgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcttcaaccgttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccctgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagcgcttacacagccttgtttagcggagtctcatggataatgaaaattggaataggtgtcctcttaacctggatagggttgaattcaaaaaacacttccatgtcattttcatgcattgtgataggaattatcacactctatctgggaaccgtggtacaagctgacatggggtgcgccataaactggaaaggaaaagaactcaaatgtggaagtggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttaggaaaattagagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttggtaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattctggccggagtttcgcttttgccactgtgccagtcttcgagcatgaggaaaacagattggctcccaatgactgtggcagccatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagagaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccgtactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgaacgcacaatggcaaaagggagaagaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcctataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttggcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagataaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaaacaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgattgctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaaccagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtgttaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcccatggtgacacagatggcaatgacggatacaactccatttgggcagcaaagagtttttaaagagaaagtggacaccaggacacccaggcccatgccagggacaagaaaggttatggagattacagcggaatggctttggagaaccctgggaaggaacaaaaaacccagattgtgcacaagagaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgatctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgactggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttaggctagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7315 - RNA, 9873 nt, synthetic construct
  misc_feature 1..9873: note = derived and/or modified CDS sequence (wt) from DENV-3__GU131942__SS-prME
  source 1..9873: mol_type = other RNA
acatcgctctgtctcatgatgatgttcccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatctttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaatcaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcttcaaccgttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagccacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacagtggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatgggtaatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccatacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacactccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccggataccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggatggctgttggtatggcatggaaattagacctatcaatgagaaagaagagaacatggtgaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccaaccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacagttttcacgttgactgttgcctggagaacagccaccttgattctggccggagtttcgcttttgccattgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagctctctccttaggaatgatgtgcccatggctggaccactagtggccgggggcttgttgatagcgtgctatgtcataactggcacgtcagcagacctcactgtagagaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggctagcgtgaaaaaagatctgatttcatacggaggaggatggagattgaacgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatccagggtcaggaaagacgcggaaatatcttccagccatcgtcagagaagcaatcaagagacgcttaagaaccctaattttggcaccaacaagagtggttgcagctgagatggaagaagcactgaaaggactcccaataaggtatcaaacaactgcaacaaaatctgaacacacaggaagggagattgttgatttaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaactcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggagaataccgcctgaagggtgagtccaggaagaccttcgtggaactcatgaggaggggtgacctcccagtttggctagcccataaagtagcctcagaagggatcaaatacacagacagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcgctcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaaccacaaagagagatctaggaatgtctaaggaaccaggtgttgtttctccaaccagctatttagatgtagacttgcacccagcatcagcctggacattgtacgccgtggccacaacagtaataacaccaatgttgagacataccatagagaattctacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggactgcaggccaaagccactcgtgaagctcaaaaaagaacagctgctggaataatgaagaatccaacggtggacgggataatgacaatagacctagatcctgtaatatacgattcaaaattcgaaaagcaactaggacaggttatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctattatgaaatcagttggagcaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttataaaacgtgggcttaccatggatcctatgaagtcaaagccacaggctcagcctcctccatgataaatggagtcgtaaaactcctcacaaaaccatgggatgtggttcccatggtgacacagatggcaatgacagatacaactccatttgggcagcaaagagtttttaaagagaaagtggacaccaggacacccaggcccatgccagggacaagaaaggtaatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtatatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggatcctgaacatagacaattagcgaacgccatatttaagctcacgtaccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagaaaagaaaatcacacaatggttggaaaccaaaggagtggagagattaaaaagaatggccatcagcggggatgattgcgtggtgaagccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctatgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7316 - RNA, 9873 nt, synthetic construct
  misc_feature 1..9873: note = derived and/or modified CDS sequence (wt) from DENV-3__GU131943__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaaccaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcaccccatccatgacaatgagatgcgtgggagtgggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcaaggagtcacggttgagataacaccccaggcttcaaccgttgaagctgtcttgcctgagtatggaacccttgggctagaatgctcaccacggacaggcctggacttcaatgaaatgattttattgacaatgaaaaacaaagcctggatggtacataggcaatggttctttgacctacccctaccatggacatcaggagctacaacagagacaccaatttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagatccctttctccacagaggacggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcttgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaacgtgtgggaggtggaagattacgggtttggagtcttcacaaccaacatatggctgaaactccgagaggtgtacacccaatcatgtgaccataggctaatgtcggcggccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttaggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctctagtctcagcagggagtggaaaggtggacaacttcacaatgggagtcctgtgtttggcaatcctcttcgaagaggtgatgagaggaaaatttgggaaaaaacacatgattgcaggggttctcttcacatttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtgggcggcattagtctccttaacatgttctaacacaattttcacgttgactgttgcctggagaacagccaccttgattctggccggagtttcgcttttgccactgtgccagtcttcgagcatgaggaaaacagattggctcccaatgactgtagcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagagaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccgtactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccacaccatgtggcacgtcacaagaggggcagtattgacgcacaatgggaaaagactggaaccaaactgggccagcgtgaaaaaagacctgatttcatacggaggaggatggagattgaacgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcccatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatttaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgcgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagactagattgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgtacttattcagatcccttagcactcaaggaattcaaggattttgcagctggtagaaagtcaatcgcccttgatcttgtgacggaaataggaagagtgccttcacacttggcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgtctccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctatgtgcagttcaacttttgttaatgagaacatcatgggccttgtgtgaagctctaaccctagctacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaaccagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacatgaagaaccagtacctatgtctacatacggatggaatatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaatatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcccatggtgacacagatggcaatgacagacacaactccatttgggcagcaaagagtttttaaagagaaagtggacaccaggacacccaggcccatgccagggacaagaaaggttatggagattacagcggaatggctttggagaaccctgggaaggaacaaaaaacccagattgtgcacaagagaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcctacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtttgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgtgtggtgaaaccgatcgatgacaggtttgccaatgccctgcttgccctgaacgacatgggaaaggttaggaaggacataccccaatggcagccatcaaaggggtggcatgactggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatctaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaagtgagaagccttataggcgatgaagaatttctggactacatgccttcgatgaagagattcaggaaggaggaggagtcagagggagccatttggtaa

SEQ ID NO: 7317 - RNA, 9873 nt, synthetic construct
  misc_feature 1..9873: note = derived and/or modified CDS sequence (wt) from DENV-3__GU131945__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaacctcacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgcgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaatcaatagagggaaaagtggtgcaatatgaaaaccttaaatacactgtcatcatcacagtgcacacaggagaccaacaccaggtgggaaatgacacgcagggagtcacagttgagataacacctcaggcatcaacagttgaagctgtcttgcctgagtatggaacccttgggctagaatgctcaccacgaacaggcctggatttcaatgaaatgattttattgacaatgaaaaacaaagcctggatggtacataggcaatggttctttgacctacccctaccatggacatcaggagctacaacagagacaccaacttggaacaggaaagagcttctcgtaacattcaaaaatgctcatgcaaaaaagcaagaagtggttgtccttggatcgcaagagggagcaatgcacacagcgctgacaggagctacagagattcaaaactcaggaggtacaagcatttttgcggggcatttgaaatgtagactcaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaaatggaatttttgtcactaatgaggtccacacttggacagagcaatataaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagagcactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtcctatttcacaacacaaccataggcccgggtaccacacccaaacggcaggaccttggcacttgggaaaattggagctggactttaactattgtgaaggaacaacagtagtcatcgcagaaaactgtgggacaagaggcccatcattgagaacaacaacagtgtcagggaagctgatacacgaatggtgttgccgctcgtgcacacttcctcccttgcgatacatgggagaggacggctgctggtatggtatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactaataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcatcctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgaaaataaaggatgatgagactgagaacatcctaacagtgctcttaaaaacagcattactaatagtttcaggcatctttccatactccatacccgccacattgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtggtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcatgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctagatggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaaccacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaggaagggttgaaaagaggagaaacaacacatcatgctgtgtccagaggcagcgcaaaacttcaatggttcgtggagaggaacatggtcattcccgaaggaagagtcatagacctaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaagacgtgttctatcttccacctgaaaagtgtgacaccctattgtgtgacattggagaatcttcaccaagcccaacagtggaagaaagcagaactataagagttttgaagatggttgagccatggttaagaagcaaccagttttgcattaaagtattaaacccttacatgccaactgtgattgagtacctagaaagactacaaagaaaatatggaggaatgcttgtgagaaacccactctcacgaaactccacgcatgaaatgtactggatatccaatggcaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacctaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttatagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggtgatgaagaatttctggactacatgccttcgatgaagagattcaggaaggaggaggagacagagggagccatttggtaa

SEQ ID NO: 7318 - RNA, 9873 nt, synthetic construct
  misc_feature 1..9873: note = derived and/or modified CDS sequence (wt) from DENV-3__GU131946__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctctcaggcacccaggtttcaccatactagctctattccttgcccattacataggcacttccctgacccagaaagtagttatttttatactactaatgttggtcactccatccatgacaatgagatgcgtgggagtagggaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgttatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggaacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagatacagcctgggactttggttcagtgggtggtattctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaatcatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaagaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgctgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagttctgtgtttggcaatcctcttcgaagaagtgatgagaggaaaatttgggaaaaaacacatgattgcaggggttctcttcacgtttgtgctcctcctctcggggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattttggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccacactatgtggcacgtcacaagaggggcagtattgacgcacaatgggaaaagactggaaccaaactgggccagcgtgaaaaaagatctgatttcatacggaggaggatggagattgagcgcacaatggcaaaaaggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaattaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggctcatttcacagacccagccagtatagcggctagagggtacatatcaactcgtgtaggaatgggagaggcagctgcaattttcatgacagcaacaccccctggaactgctgaagcttttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcttgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcttagaactcatgaggaggggtgacctcccagtttggctagcccataaagtagcctcagaagggatcaaatacacagatagaaaatggtgctttgatggagaacgtaataatcaaattttagaggagaatatggatgtggaaatctggacaaaggaaggagaaaggaaaaaactgagacctaggtggcttgatgcccgcacttattcagatcccttagcactcaaggaattcaaggatttcgcagctggcagaaagtcaatcgccctcgatcttgtgacagaaataggaagagtgccttcacacttagcccacagaacgagaagcgccctggacaacttggtgatgctgcacacgtcagaacatggcggtagggcctacaggcatgcagtagaggaactaccagaaacaatggaaacactcctactcttgggactcatgatcttactaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaactagctatttagatgtagacttgcacccagcatcagcctggacactgtacgccgtggccacaacagtaataacaccaatgttgagacacaccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaactgctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaggaaccagtacctatgtctacatacggatggaacatagtcaagttaatgagtggaaaggacgtgttttatcttccacctgagaagtgtgacaccctactgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaaggataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcctatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggataacgcgagagctgctgttgaggacgaggaattctggaaacttgtggacagagaacgtgaactccacaaattgggcaagtgtggaagctgcatctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaggtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggacagattaaaaagaatggccatcagcggggatgattgcgtggtgaaaccgatcgatgacaggtttgccaatgccctgcttgccctgaacgacatgggaaaggttaggaaggatataccccaatggcagccatcaaaggggtggcatgattggcaacaggtccctttctgctcccaccactttcacgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggtgatgaagaatttctggactacatgccttcgatgaaaagattcaggaaggaggaggagtcagagggagccatttggtaa

SEQ ID NO: 7319 - RNA, 9873 nt, synthetic construct
  misc_feature 1..9873: note = derived and/or modified CDS sequence (wt) from DENV-3__FJ639712__SS-prME
  source 1..9873: mol_type = other RNA
acatcgctctgtctcatgatgatgttcccagcaacacttgcttttcacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactggctctatttcttgcccattacataggcacttccctgacccagaaagtggttatctttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggatatagagcttcagaagaccgaggccacccaactggcgaccctaaggaagttatgcattgagggaaaaatcaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgatacgcagggagtcacggttgagataacaccccaggcttcaaccgttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagccacagagattcaaaactcaggaggtacaagcatttttgcggggcacctgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacagtggtagattgatcacagccaacccagtggtgaccaagaaggaggagcctgtcaacattgaggctgaacctccttttggggaaagcaacatagtgattggaattggagacaaagccttgaaaattaactggtacaagaaggggagctcgattgggaagatgttcgaggccactgccagaggtgcaagacgcatggccatcttgggagacacagcctgggactttggttcagtgggtggtgttctaaattcattagggaaaatggtgcaccaaatattcggaagtgcttacacagccctgtttagcggagtctcatgggtaatgaaaataggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggccacagccatcgcaggcgcttgggaaaatggagtctgtggaatcaggtcaacaaccagaatggagaatctattgtggaagcaaatagccaatgagctgaactacatattatgggaaaacaacatcaaattaacggtggttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacactccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccgaaatcacacactctttggagcaatggtgtactagagagtgacatgatcatcccaaagagtctagctggtcctatttcacaacacaaccacaggcccggataccacacccaaacggcaggaccttggcacttgggaaaattggagctggactttaactattgtgaaggaacaacagtagtcattacagaaaactgtgggacaagaggcccatcattgagaacaacaacggtgtcagggaagctgatacacgaatggtgttgccgctcgtgcacacttcctcccttgcgatacatgggagaggatggctgttggtatggcatggaaattagacctatcaatgagaaagaagagaacatggtgaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccctgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagagaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttggaaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgaacgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaaccctaattttggcaccaacaagagtggttgcagctgagatggaagaagcactgaaaggactcccaataaggtatcaaacaactgcaacaaaatctgaacacacaggaagggagattgttgatttaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaactcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgaatgggacttcgtggtgacaacagacatttcagaaatgggagctaactttaaagcagatagagtgattgacccaagaagatgtctcaagccagtaatcttgacagatggacctgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacgcagacagaaaatggtgctttgatggagaacgtaataatcaaattttagaggagaacatggatgtggaaatctggacaaaagaaggagaaaggaaaaaactgagacctaggtggcttgacgcccgcacttattcagatcccttagcgctcaaggaattcaaggattttgcagctggcagaaagtcaatcgcccttgatcttgtgacagaaataggaagagtgccctcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacattggctgcgatagtagcagctaatgaaatgggattattggaaactacaaagagagatttaggaatgtctaaggaaccaggtgttgtttctccaaccagctatttagatgtagacttgcacccagcatcagcctggacattgtacgccgtggccacaacagtaataacaccaatgttgagacataccatagagaattctacggcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggactgcaggccaaagccactcgtgaagctcaaaaaagaacagctgctggaataatgaagaacccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttccatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtttttaaagagaaagtggacaccaggacacccaggcccatgccagggacaagaaaggtaatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggatcctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaagccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctatgctcaaatgtggagtctcatgtattttcacagaagagatcttagactagcatccaacgccatttgttcagcagtaccagtccattggatccctacaagcagaacgacatggtccattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7320 - RNA, 9873 nt, synthetic construct
  misc_feature 1..9873: note = derived and/or modified CDS sequence (wt) from DENV-3__FJ639713__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttacttttcaagacagcttctggaatcaacatgtgcactctcatagctatggacttgggagagatgtgtgatgacacggtcacttataagtgccccctcattgctgaagtggaaccagaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgcgtgaccaccatggctaagagcaagcctacgctggacatagagcttcaaaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatatgtggacagaggttggggaaacggttgtggtttgtttggaaaaggaagcttggtgacatgcgcgaaatttcagtgtctagaaccaatagagggaaaagtggtgcaatatgagaaccttaaatacactgtcatcatcacagtgcacacaggagaccaacaccaggtgggaaatgacacgcagggagtcacggttgagataacacctcaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaaacaagaagtggttgtccttggatcgcaagagggagcaatgcacacagcgctgacaggagctacagagattcaaaactcaggaggtacaagcatttttgcggggcatttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccaccgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaaatggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtcctatttcacaacacaaccataggcccgggtaccacacccaaacggcaggaccttggcacttgggaaaattggagctggactttaactattgtgaaggaacaacagtagtcatcgcagaaaactgtgggacaagaggcccatcattgagaacaacaacagtatcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacctagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcattttccagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagccccttaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccatagaacgagaaacgccctggacaacttggtgatgctgcacacgtcagaacatggcggtagggcctacagacatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaaccacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagatcagaagccaaagaagggttgaaaagaggagaaacaacacatcatgctgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaggaaccagtacctatgtctacatacggatggaacatagtcaagttaatgagtggaaaggacgtgttctatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaacatggaggaatgcttgtgagaaacccactctcacgaaactccacgcatgaaatgtactggatatccaatggtaccggcaacatcgtctcttcagtcaatatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcttcctccatgataaatggagtcgtgaaactcctcacaaaaccatgggatgtggttcccatggtgacacagatggcaatgacagatacaactccatttgggcagcaaagagtcttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaatatgatgggcaagagagagaaaaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcatacaatggttggaaaccaaaggagtggagagattaaaaagaatggccatcagcggggatgattgcgtggtgaaaccgatcgatgacaggtttgccaatgccctgcttgccttgaacgacatgggaaaggtcaggaaggacataccccaatggcagccatcaaaggggtggcatgattggcaacaggtccctttctgctcccaccactttcatgaactgatcatgaaagatggaagaaagctggtggttccctgcagaccccaggacgaactaataggaagggcgagaatctctcaaggagcaggatggagccttaaagaaactgcatgcctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctttctgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7321 - RNA, 9873 nt, synthetic construct
  misc_feature 1..9873: note = derived and/or modified CDS sequence (wt) from DENV-3__FJ639714__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaacctcacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaattggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgaaaaccttaaatacactgtcatcatcacagtgcacacaggagaccaacaccaggtgggaaatgacacgcagggagtcacagttgagataacaccccaggcatcaaccgttgaagctgtcttgcctgagtatggaacccttggactagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgctcatgcaaaaaagcaagaagtggttgtccttggatcgcaagagggagcaatgcacacagcgctgacaggagctacagagattcaaaactcaggaggtacaagcatttttgcggggcatttgaaatgtagactcaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaaatggaatttttgtcactaatgaggtccacacttggacagagcaatacaaatttcaagcagactcccccaaaagactggcgacagccatcgcaggcgcttgggaaagtggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtcctatttcacaacacaaccataggcccgggtaccacacccaaacggcaggaccttggcacttgggaaaattggagctggactttaactattgtgaaggaacaacagtagtcatcgcagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaattcagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactaataacacaatttgagacatatcagttgtggacggcactagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcatcctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtttcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaggtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtggtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgacttcgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcttacaggcatgcagtagaggaactaccagaaacaatggaaacactcctactcttgggactcatgatcttattaacaggtggagcaatgcttttcttgatatcaggtaaagggattggaaagacttcaataggacttatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaaccacaaagagagatttaggaatgtctaaagaaccaggtgttgtttctccaaccagctatttagatgtagatttgcacccagcatcagcctggacattgtacgccgtggccacaacaataataacaccaatgttgagacataccatagagaattccacagcaaatgtttccctggcagccatagctaaccaggcagtggtcctgatgggtttagacaaaggatggccaatatcgaaaatggacctaggcgtaccgctattggcactgggctgctattcacaagtgaacccactgactctcacagcggcagtacttctgctagttacacattatgccattataggtccaggattgcaggctaaagccactcgtgaagcccaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgaggacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaggaagggttgaaaagaggagaaacaacacatcatgctgtgtccagaggcagcgcaaaacttcaatggttcgtggagaggaacatggtcattcccgaaggaagagtcatagacctaggctgtggaagaggaggctggtcatattattgcgcgggactgaaaaaagttacagaagtgcgaggatacacaaaaggcggcccaggacacgaagaaccagtacctatgtctacatacggatggaacatagtcaagttaatgagtggaaaggacgtgttctatcttccacctgaaaagtgtgacaccctattgtgtgacattggagaatcttcaccaagcccaacagtggaagaaagcagaactataagagttttgaagatggttgagccatggttaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaagacgaggaattctggaaacttgtggacaaagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctggacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaggaaactgcatgtctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttaccgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggtgatgaagaatttctggactacatgccttcgatgaagagattcaggaaggaggaggagacagagggagccatttggtaa

SEQ ID NO: 7322 - RNA, 9873 nt, synthetic construct
  misc_feature 1..9873: note = derived and/or modified CDS sequence (wt) from DENV-3__FJ639715__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcctctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagctgtcttgcccgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagctctgacaggagctacagagattcaaaactcaggaggtacaaacatttttgcggggcatttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctatcaacattgaggctgaacctccttttggggaaagcaacatagtgattggaattggagacaaagccttgaaaattaactggtacaagaagggaagctcgattgggaagatgttcgaggctactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttgacctggatagggttgaattcaaaaaacacttccatgtcattttcatgcattgtgataggaattatcacactctatctgggagccgtggtacaggctgacatggggtgcgtcataaactggaaaggaaaagaactcaaatgtggaaatggaatttttgtcaccaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgcacctggccgaaatcacacactctttggagcaatggtgtactagagagtgacatgatcatcccaaagagtctagctggtcctatttcacaacacaaccataggcccgggtaccacacccaaacggcaggaccttggcacttgggaaaattggagctggactttaactattgtgaaggaacaacagtagtcatcgcggaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctctttaacatgttcaaacacaattttcacgttgacggttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaagagctggccactgaatgagggagtgatggctgttgggcttgtgagcattttagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggattaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacgacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccaacaccggaattggaagaagaaatgttcaaaaagcgaaatctaactataatggatcttcatcctgggtcaggaaagacgcggaaatatcttccagctatcgtcagagaagcaatcaagagacgcctaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttgataataatggatgaggcccatttcacagacccagccagtatagcggctagagggtacatatcaactcgtgtaggaatgggagaggcagctgcaattttcatgacagcaacaccccctggaactgctgaagcttttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctcttcgaaccagagagggagaagtcagccgctatagacggtgaataccgcctgaagggtgagtccaggaagactttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacctattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacattggccgcgatagtagcagctaatgaaatgggattattggaaaccacaaagagagatctaggaatgtctaaagaaccaggtgttgtttctccaaccagctatttagatgtagacttgcacccagcatcagcctggacattgtacgccgtggccacaacagtgataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatctacgattcaaaattcgaaaagcaactaggacaggtcatgctcttggttttgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgatctttacaagaaatctggaatcactgaagtggatagaacagaagccaaagaagggttgaaaagaggagaaacaacacatcatgctgtgtccagaggcagcgcaaaacttcaatggttcgtggagaggaacatggtcattcccgaaggaagagtcatagacttaggctgtggaagaggaggctggtcatattattgcgctggactgaaaaaagttacagaagtgcgagggtacacaaaaggcggtccaggacacgaagaaccagtacctatgtctacatacggatggaacatagtcaagttaatgagtggaaaggacgtgttctatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaaatgtgattgagcacttagaaagactacaaagaaaatatggaggaatgcttgtgagaaacccactctcacgaaactccacgcatgaaatgtactggatatccaatggtaccggcaacatcgtctcctcagtcaacatggtatccagattgctactgaacagatttacgatgacacacaggagacccaccatagagaaagatgtggatctgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagacacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcggaggcagacctcgagaaccctcatctgctagagaagaaaatcacacaatggttggaaaccaaaggagtggagagattaaaaagaatggctatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaattcctggactacatgccttcgatgaagagattcaggaaggaggaggagtcagagggagccatttggtaa

SEQ ID NO: 7323 - RNA, 9873 nt, synthetic construct
  misc_feature 1..9873: note = derived and/or modified CDS sequence (wt) from DENV-3__KF955461__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagaacaagcccacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagccacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgtcctaaattcattagggaaaatggtgcaccaagtattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggactttaactattgtgaaggaacaacagtagccatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaacttccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcaagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgttataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagatccagccagtatagcggctagagggtacatatcaactcgtgtaggaatgggagaggcagctgcaattttcatgacagcaacaccccctggaactgctgaagcctttcctcagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgctgagacataccatagagaattccacagcaaatgtatccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagagacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatcagctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggaatcagagggagccatttggtaa

SEQ ID NO: 7324 - RNA, 9873 nt, synthetic construct
  misc_feature 1..9873: note = derived and/or modified CDS sequence (wt) from DENV-3__FJ639719__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacagctactggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcattagctccccatgtcggcatgggactggacacacgtacccaaacctggatgtcggctgaaggagcttggagacaagtcgagaaggtagagacatgggctcttaggcacccaggtttcaccatactagctctatttcttgctcattacataggcacttccctgatccagaaagtggtcatttttatactactaatgctggtcactccatccatgacaatgagatgcgtgggagtaggaaacagagattttgtggaaggtctgtcaggagctacgtgggttgatgtggtgctagagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatacgagaacctcaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaagaacaaagcctggatggtacataggcaatggttctttgacctacccctaccatggacatcaggagcaacaacagagacaccaacttggaacaggaaagagcttcttgtaacattcaaaaatgcacatgcaaaaaagcaagaagtagttgtccttggatcgcaagagggagcaatgcacacagcgctgacaggagctacggagattcaaaactcaggaggtacaagcatttttgcggggcacttgaaatgtaggcttaagatggacaaattggaactcaaggggatgagctatgcaatgtgcttgaatacctttgtgttgaagaaagaagtctccgagacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgtttgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctccttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaatcacaggcccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtactgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacccacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcactagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatctttagcttgaaggacacacccaaaaggaggagctggccactgaatgagggagtgatggctgtcgggcttgtgagcattctggctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtatataggatcaaacaacaaggaatctttgggaaaacccaagtgggggttggagtgcagaaagaaggagtcttccacaccatgtggcacgtcacaagaggggcagtgttgacgcacaatgggaaaagactggaaccaaactgggcaagtgtgaaaaaagatctgatttcatacggaggaggatggagattgagcacacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggattgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataagatatcaaacaaccgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcgtggaattcaggcaatgaatggattaccgactttgttgggaagacggtgtggtttgtccctagcatcaaagccggaaatgacatagcaaactgcctgcgaaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggccggaccaatgccagtcaccgcagcaagcgctgcgcaaaggagagggagagttggcaggaacccacaaaaagaaaatgaccagtacatattcacgggccagcctcttaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcaggaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttggtatcaggtaaagggattggaaagactacaataggactcatttgtgttatcgtttccagtggtatgttatggatggctgatatcccacttcaatggatcgcgtcggctatagtcctggaatttttcatgatggtgttgctcataccagaaccagaaaaacaaagaactccccaagacaaccaactcgcatatgtcgtgataggcatactcacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacttaggcgtaccgctactggcactgggctgctattcacaagtgaacccactgactctcacagcggcagtacttctgctagtcacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctatttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaaccataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtattcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagctatatggtacatgtggttgggagctaggttccttgagttcgaagcactcggatttttaaatgaagaccactggttctcgcgtgaaaactcttacagtggagtagaaggagaaggactgcacaagctgggatacattttaagagacatctctaagatacccggaggagccatgtatgctgatgacacagctggttgggacacaagaataacagaagatgacttgcacaatgaggaaaaaatcacacagcaaatggaccctgaacacagacaattagcgaacgccatattcaagctcacataccaaaacaaagtggtcaaagtacaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgttagagaagaaaatcacacaatggttggaaaacaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaagtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactggcatccaacgccatttgttcagcagtgccagtccattgggtccctacgagcagaacgacatggtctattcacgctcaccatcagtggatgaccacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7325 - RNA, 9873 nt, synthetic construct
  misc_feature 1..9873: note = derived and/or modified CDS sequence (wt) from DENV-3__KF955332__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacagctactggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctatttcttgctcattacataggcacttccctgatccagaaagtggtcatttttatactactaatgctggtcactccatccatgacaatgagatgcgtgggagtaggaaacagagattttgtggaaggtctgtcaggagctacgtgggttgatgtggtgctagagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatacgagaacctcaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaagaacaaagcctggatggtacataggcaatggttctttgacctacccctaccatggacatcaggagcaacaacagagacaccaacttggaacaggaaagagcttcttgtaacattcaaaaatgcacatgcaaaaaagcaagaagtagttgtccttggatcgcaagagggagcaatgcacacagcgctgacaggagctacggagattcaaaactcaggaggtacaagcatttttgcggggcacttgaaatgtaggcttaagatggacaaattggaactcaaggggatgagctatgcaatgtgcttgaatacctttgtgttgaagaaagaagtctccgagacgcagcatgggacaatactcattaaggttgagtacaaaggggaagatgcaccttgcaagattcctttctccacagaggatggacaagggaaagcccacaatggtagactgattacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgtttgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaatcacaggcccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagctgatacacgagtggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtactgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcactagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacgcacccaaaaggaggagctggccactgaatgagggagtgatggctgtcgggcttgtgagcattctggctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatctttgggaaaacccaagtgggggttggagtgcagaaagaaggagtcttccacaccatgtggcacgtcacaagaggggcagtgttgacgcacaatgggaaaagactggaaccaaactgggcaagtgtgaaaaaagatctgatttcatacggaggaggatggagattgagcacacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggattgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataagatatcaaacaaccgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcgtggaattcaggcaatgaatggattaccgactttgttgggaagacggtgtggtttgtccctagcatcaaagccggaaatgacatagcaaactgcctgcgaaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggccggaccaatgccagtcaccgcagcaagcgctgcgcaaaggagagggagagttggcaggaacccacaaaaagaaaatgaccagtacatattcacgggccagcctcttaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataaccaaattttagaggagaacatggatgtggaaatctggacaaaggaaggagaaaggaaaaaattgagacctaggtggcttgatgcccgcacttattcagatcccttagcactcaaggaattcaaggattttgcagctggcaggaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttggtatcaggtaaagggattggaaagactacaataggactcatttgtgttattgtttccagtggcatgttatggatggctgatatcccacttcaatggatcgcgtcggctatagtcctggaatttttcatgatggtgttgctcataccagaaccagaaaaacaaagaactccccaagacaaccaactcgcatatgtcgtgataggcatactcacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtagccacaacagtaataacaccaatgttgagacataccatagagaattccacagcaaatgtgtccttggcagccatagctaaccaggcagtggtcctgatgggtttagacaaaggatggccaatatcgaaaatggacttaggcgtaccgctactggcactgggctgctattcacaagtgaacccactgactctcacagcggcagtacttctgctagtcacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctatttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaaccataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtattcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagctatatggtacatgtggttgggagctaggttccttgagttcgaagcactcggatttttaaatgaagaccactggttctcgcgtgaaaactcttacagtggagtagaaggagaaggactgcacaagctgggatacattttaagagacatctctaagatacccggaggagccatgtatgctgatgacacagctggttgggacacaagaataacagaagatgacttgcacaatgaggaaaaaatcacacagcaaatggaccctgaacacagacaattagcgaacgccatattcaagctcacataccaaaacaaagtggtcaaagtacaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaagacagacctcgagaaccctcatctgttagagaagaaaatcacacaatggttggaaaacaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaagtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactggcatccaacgccatttgttcagcagtgccagtccattgggtccctacgagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7326 - RNA, 9873 nt, synthetic construct
  misc_feature 1..9873: note = derived and/or modified CDS sequence (wt) from DENV-3__FJ639720__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacagctactggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctatttcttgctcattacataggcacttccctgatccagaaagtggtcatttttatactactaatgctggtcactccatccatgacaatgagatgcgtgggagtaggaaacagagattttgtggaaggtctgtcaggagctacgtgggttgatgtggtgctagagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatacgagaacctcaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaagaacaaagcctggatggtacataggcaatggttctttgacctacccctaccatggacatcaggagcaacaacagagacaccaacttggaacaggaaagagcttcttgtaacattcaaaaatgcacatgcaaaaaagcaagaagtagttgtccttggatcgcaagagggagcaatgcacacagcgctgacaggagctacggagattcaaaactcaggaggtacaagcatttttgcggggcacttgaaatgtaggcttaagatggacaaattggaactcaaggggatgagctatgcaatgtgcttgaatacctttgtgttgaagaaagaagtctccgagacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgagaattaactggtacaagaagggaagctcgattgggaagatgtttgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaatcacaggcccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtactgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcactagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgtcgggcttgtgagcattctggctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaaacaaacccaaagatctggcgttctatgggacgtacccagccccccagaaacacagaaagcagaactggaagagggggtctataggatcaaacaacaaggaatctttgggaaaacccaagtgggggttggagtgcagaaagaaggagtcttccacaccatgtggcacgtcacaagaggggcagtgttgacgcacaatgggaaaagactggaaccaaactgggcaagtgtgaaaaaagatctgatttcatacggaggaggatggagattgagcacacaatggcaaaaaggagaggaggtacaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggattgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataagatatcaaacaaccgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcgtggaattcaggcaatgaatggattaccgactttgttgggaagacggtgtggtttgtccctagcatcaaagccggaaatgacatagcaaactgcctgcgaaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggccggaccaatgccagtcaccgcagcaagcgctgcgcaaaggagagggagagttggcaggaacccacaaaaagaaaatgaccagtacatattcacgggccagcctcttaacaatgacgaagaccatgctcactggacagaagcaaaaatgctgctagacaatatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataaccaaattttagaggagaacatggatgtggaaatctggacaaaggaaggagaaaggaaaaaattgagacctaggtggcttgatgcccgcacttattcagatcccttagcactcaaggaattcaaggattttgcagctggcaggaagtcaatcgccattgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttggtatcaggtaaagggattggaaagactacaataggactcatttgtgttattgtttccagtggcatgttatggatggctgatatcccacttcaatggatcgcgtcggctatagtcctggaatttttcatgatggtgttgctcataccagaaccagaaaaacaaagaactccccaagacaaccaactcgcatatgtcgtgataggcatactcacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccttggcagccatagctaaccaggcagtggtcctgatgggtttagacaaaggatggccaatatcgaaaatggacttaggcgtaccgctactggcactgggctgctattcacaagtgaacccactgactctcacagcggcagtacttctgctagtcacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctatttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaaccataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtattcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagctatatggtacatgtggttgggagctaggttccttgagttcgaagcactcggatttttaaatgaagaccactggttctcgcgtgaaaactcttacagtggagtagaaggagaaggactgcacaagctgggatacattttaagagacatctctaagatacccggaggagccatgtatgctgatgacacagctggttgggacacaagaataacagaagatgacttgcacaatgaggaaaaaatcacacagcaaatggaccctgaacacagacaattagcgaacgccatattcaagctcacataccaaaacaaagtggtcaaagtacaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaagacagacctcgagaaccctcatctgttagagaagaaaatcacacaatggttggaaaacaaaggagtggagagattaaaaagaatggccatcagcggggatgattgcgtggtgaaaccgatcgatgacaggtttgccaatgccctgcttgccctgaacgacatgggaaaggttaggaaggatatacctcaatggcagccatcaaaggggtggcatgattggcaacaagtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactggcatccaacgccatttgttcagcagtgccagtccattgggtccctacgagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7327 - RNA, 9873 nt, synthetic construct
  misc_feature 1..9873: note = derived and/or modified CDS sequence (wt) from DENV-3__GQ868626__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacagctactggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgtgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctatttcttgctcattacataggcacttccctgatccagaaagtggtcatttttatactactaatgctggtcactccatccatgacaatgagatgcgtgggagtaggaaacagagattttgtggaaggtctgtcaggagctacgtgggttgatgtggtgctagagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaggcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatacgagaacctcaaatacactgttatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaagaacaaagcctggatggtacataggcaatggttctttgacctacccctaccatggacatcaggagcaacaatagagacaccaacttggaacaggaaagagcttcttgtaacattcaaaaatgcacatgcaaaaaagcaagaagtagttgtccttggatcgcaagagggagcaatgcacacagcgctgacaggagctacggagattcaaaactcaggaggtacaagcatttttgcggggcacttgaaatgtaggcttaagatggacaaactggaactcaaggggatgagctatgcaatgtgcttgaatacctttgtgttgaggaaagaagtctccgagacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgtttgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacttggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagccggtcccatttcacaacacaatcataggcccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagctgatacacgaatggtgttgccgctcatgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgtcgggcttgtgagcattctggctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttgaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggcaagtgtgaaaaaagatctgatttcatacggaggaggatggagattgagcacacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataagatatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcgtggaactcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggccggaccaatgccagtcaccgcagcaagcgctgcgcaaaggagagggagagttggcaggaacccacaaaaagaaaatgaccagtacatattcacgggccagcctcttaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcctataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcggatcccttagcactcaaggaattcaaggattttgcagctggcaggaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagactacaataggactcatttgtgtcattgtttccagtggcatgttatggatggctgatatcccacttcaatggatcgcgtcggctatagtcctggaattttttatgatggtgttgctcataccagaaccagaaaaacaaagaactccccaagacaaccaactcgcatatgtcgtgataggcatactcacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacttaggcgtaccgctactggcactgggctgctattcacaagtgaacccactgactctcacagcggcagtacttctgctagtcacacattatgccattataggtccaggattgcaggctaaagccactcgtgaagctcaaaaaagaacagctgctggaataatgaagaatccaacggtggatgggataatgacaatagacctagatcctgtgatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctatttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagtcacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaaccataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtactggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtattcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaacttcacaaattgggcaagtgtggaagctgcgtctacaacatgatgggcaagagagagaagaaacttggagagtttggcaaagcaaaaggcagtagagctatatggtacatgtggttgggagctaggttccttgagttcgaagcactcggatttttaaatgaagaccactggttctcgcgtgaaaactcttacagtggagtagaaggagaaggactgcacaagctgggatacattttaagagacatctctaagatacccggaggagccatgtatgctgatgacacagctggttgggacacaagaataacagaagatgacctgcacaatgaggaaaaaatcacacagcaaatggaccctgaacacagacaattagcgaacgccatattcaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgttagagaagaaaatcacacaatggttggaaaacaaaggagtggagagattaaaaagaatggccatcagcggggatgattgcgtggtgaaaccgatcgatgacaggtttgctaatgccctgcttgccctgaacgacatgggaaaggttaggaaggacatacctcaatggcagccatcaaaggggtggcatgattggcaacaagtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcttacgctcaaatgtggagtctcatgtattttcacagaagagatcttagactggcatccaacgccatttgttcagcagtgccagtccattgggtccctacgagcagaacgacatggtctattcacgctcaccatcagtggatgactacagaagacatgcttgctgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7328 - RNA, 9873 nt, synthetic construct
  misc_feature 1..9873: note = derived and/or modified CDS sequence (wt) from DENV-3__GQ868627__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacagctactggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgtgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctatttcttgctcattacataggcacttccctgatccagaaagtggtcatttttatactactaatgctggtcactccatccatgacaatgagatgcgtgggagtaggaaacagagattttgtggaaggtctgtcaggagctacgtgggttgatgtggtgctagagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaggcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatacgagaacctcaaatacactgttatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaagaacaaagcctggatggtacataggcaatggttctttgacctacccctaccatggacatcaggagcaacaacagagacaccaacttggaacaggaaagagcttcttgtaacattcaaaaatgcacatgcaaaaaagcaagaagtagttgtccttggatcgcaagagggagcaatgcacacagcgctgacaggagctacggagattcaaaactcaggaggtacaagcatttttgcggggcacttgaaatgtaggcttaagatggacaaactggaactcaaggggatgagctatgcaatgtgcttgaatacctttgtgttgaggaaagaagtctccgagacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgtttgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacttggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagccggtcccatttcacaacacaatcataggcccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagctgatacacgaatggtgttgccgctcatgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgtcgggcttgtgagcattctggctagttctctccttaggaatgatgtgcccatggctggaccattagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttgaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatctttgggaaaacccaagtgggggttggagtgcagaaagaaggagtcttccacaccatgtggcacgtcacaagaggggcagtgttgacgcacaatgggaaaagactggaaccaaactgggcaagtgtgaaaaaagatctgatttcatacggaggaggatggagattgagcacacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataagatatcaaacaactgcaacaaaatctgaacacacaggaagggagattgttgatttaatgtgccacgcaacattcacaatgcgcttgctatcaccagtcagggttccaaattacaatctgataataatggatgaggcccatttcacagatccagccagtatagcggctagagggtacatatcaacccgtgtaggaatgggagaggcagctgcaattttcatgacagcaacaccccctggaactgctgaagcctttccccagagcaacgctccaattcaagatgaagaaagggatattccggaacgctcgtggaactcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggccggaccaatgccagtcaccgcagcaagcgctgcgcaaaggagagggagagttggcaggaacccacaaaaagaaaatgaccagtacatattcacgggccagcctcttaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcctataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcggatcccttagcactcaaggaattcaaggattttgcagctggcaggaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagactacaataggactcatttgtgttattgtttccagtggcatgttatggatggctgatatcccacttcaatggatcgcgtcggctatagtcctggaattttttatgatggtgttgctcataccagaaccagaaaaacaaagaactccccaagacaaccaactcgcatatgtcgtgataggcatactcacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacttaggcgtaccgctactggcactgggctgctattcacaagtgaacccactgactctcacagcggcagtacttctgttagtcacacattatgccattataggtccaggattgcaggctaaagccactcgtgaagctcaaaaaagaacagctgctggaataatgaagaatccaacggtggatgggataatgacaatagacctagatcctgtgatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctatttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagtcacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaaccataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtactggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtattcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaacttcacaaattgggcaagtgtggaagctgcgtctacaacatgatgggcaagagagagaagaaacttggagagtttggcaaagcaaaaggcagtagagctatatggtacatgtggttgggagctaggttccttgagttcgaagcactcggatttttaaatgaagaccactggttctcgcgtgaaaactcttacagtggagtagaaggagaaggactgcacaagctgggatacattttaagagacatctctaagatacccggaggagccatgtatgctgatgacacagctggttgggacacaagaataacagaagatgacctgcacaatgaggaaaaaatcacacagcaaatggaccctgaacacagacaattagcgaacgccatattcaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgttagagaagaaaatcacacaatggttggaaaacaaaggagtggagagattaaaaagaatggccatcagcggggatgattgcgtggtgaaaccgatcgatgacaggtttgctaatgccctgcttgccctgaacgacatgggaaaggttaggaaggacatacctcaatggcagccatcaaaggggtggcatgattggcaacaagtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcttacgctcaaatgtggagtctcatgtattttcacagaagagatcttagactggcatccaacgccatttgttcagcagtgccagtccattgggtccctacgagcagaacgacatggtctattcacgctcaccatcagtggatgactacagaagacatgcttgctgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagaaggagccatttggtaa

SEQ ID NO: 7329 - RNA, 9873 nt, synthetic construct
  misc_feature 1..9873: note = derived and/or modified CDS sequence (wt) from DENV-3__FJ639721__SS-prME
  source 1..9873: mol_type = other RNA
acatcgctctgcctcatgatgatgttaccagcaacacttgctttccacttgacttcacgcgatggagagccgcgcatgattgtggggaagaatgaaagagggaaatccctactttttaagacagctactggaatcaacatgtgcacactcatagctatggacttgggagagatgtgtgatgacacggtcacttataaatgccccctcattgtcgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcagctgaaggagcttggagacaagtcgagaaggtagagacatgggctcttaggcacccaggtttcaccatactagctctatttcttgctcattacataggcacttccctgatccagaaagtggtcatttttatactactaatgctggtcactccatccatgacaatgagatgcgtgggagtaggaaacagagattttgtggaaggtctgtcaggagctacgtgggttgatgtggtgttagagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatacgagaacctcaaatacactgtcatcatcacagtgcacacaggagaccaacaccaggtgggaaatgacacacagggagtcacggttgagataacaccccaggcatcaaccgttgaagctgtcttgcctgagtatggaacccttgggctagaatgctcaccacggacaggcttggatttcaatgaaatgattttattgacaatgaagaacaaagcctggatggtacataggcaatggttctttgacctacccctaccatggacatcaggagcaacaacagagacaccaacttggaacaggaaagagcttctcgtaacattcaaaaatgcacatgcaaaaaagcaagaagtagttgtccttggatcgcaagagggagcaatgcacacagcgctgacaggagctacggagattcaaaactcaggaggtacaagcattttcgcggggcacttgaaatgtaggcttaagatggacaaattggaactcaaggggatgagctatgcaatgtgcttgaatacctttgtgttgaagaaagaagtctccgagacgcagcatgggacaatactcattaaggttgagtacaaaggggaagatgcaccttgcaagattcctttctccacagaggatggacaagggaaagcccacaatggtagactgattacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgtttgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaatcacaggcccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagctgatacacgagtggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtactgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttgactttgggattcttcctgaggaaattgacatctagagaaaatttgctgttgggagttgggttggccatggcaacaacgttacaactgccagaggacattgaacaaatggcgaatggaattgctctggggctcatgactctaaaactgataacgcaatttgagacatatcagttgtggacggcactagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacgcacccaaaaggaggagctggccactgaatgagggagtgatggctgtcgggcttgtgagcattctggctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatctttgggaaaacccaagtgggggttggagtgcagaaagaaggagtcttccacaccatgtggcacgtcacaagaggggcagtgttgacgcacaatgggaaaagactggaaccaaactgggcaagtgtgaaaaaagacctgatttcatacggaggaggatggagattgagcacacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggattgtatggcaatggagtggttacaaaaaatggtggctacgtcagtggaatagcgcaaacaaatgcagaaccagacggaccgacaccggaattggaagaagaaatgtttaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataagatatcaaacaaccgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcgtggaattcaggcaatgaatggattaccgactttgttgggaagacggtgtggtttgtccctagcatcaaagccggaaatgacatagcaaactgcctgcgaaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtcttaagccagtaattttgacagatggacccgagcgagtgatcctggccggaccaatgccagtcaccgcagcaagcgctgcgcaaaggagagggagagttggcaggaacccacaaaaagaaaatgaccagtacatattcacgggccagcctcttaacaatgacgaagaccatgctcactggacagaagcaaaaatgctgctagacaacatcaacacaccagaagggatcataccagctctctttgaaccagagagggagaagtcagccgccatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataaccaaattttagaggagaacatggatgtggaaatctggacaaaggaaggagaaaggaaaaaattgagacctaggtggcttgatgcccgcacttattcagatcccttagcactcaaggaattcaaggattttgcagctggcaggaagtcaattgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttggtatcaggtaaagggattggaaagactacaataggactcatttgtgttattgtttccagtggcatgttatggatggctgatatcccacttcaatggatcgcgtcggctatagtcctggaatttttcatgatggtgttgctcataccagaaccagaaaaacaaagaactccccaagacaaccaactcgcatatgtcgtgataggcatactcacactggctgcaatagtagcagctaatgaaatgggattattggaaactacaaagagagatttaggaatgtctaaagaaccaggtgttgtttctccaaccagctatttagatgtagacttgcacccagcatcagcctggacattgtacgccgtagccacaacagtaataacaccaatgttgagacataccatagagaattccacagcaaatgtgtccttggcagccatagctaaccaggcagtggtcctgatgggtttagacaaaggatggccaatatcgaaaatggacttaggcgtaccgctactggcactgggctgctattcacaagtgaacccactgactctcacagcggcagtacttctgctagtcacacattatgccattataggtccaggattgcaggctaaagccactcgtgaagctcaaaaaagaacagctgctggaataatgaagaatccaacagtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctatctagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaaccataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccggaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtattcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcgaaaggcagtagagctatatggtacatgtggttgggagctaggttccttgagttcgaagcactcggatttttaaatgaagaccactggttctcgcgtgaaaactcttacagtggagtagaaggagaaggactgcacaagctgggatacattttaagagacatctctaagatacccggaggagccatgtatgctgatgacacagctggttgggacacaagaataacagaagatgacttgcacaatgaggaaaaaatcacacagcaaatggaccctgaacacagacaattagcgaacgccatattcaagctcacataccaaaacaaagtggtcaaagtacaacgaccaactccaaaaggcacggtaatggacatcatatctaggaaagaccaaagaggcagtggacaggtggggacttatggactgaacacattcaccaacatggaagcccagttagtcagacagatggaaggagaaggcgtgttgtcgaagacagacctcgagaaccctcatctgttagagaagaaaatcacacaatggttggaaaacaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaagtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactggcatccaacgccatttgttcagcagtgccagtccattgggtccctacgagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7330 - RNA, 9873 nt, synthetic construct
  misc_feature 1..9873: note = derived and/or modified CDS sequence (wt) from DENV-3__FJ639722__SS-prME
  source 1..9873: mol_type = other RNA
acatcgctctgcctcatgatgatgttaccagcaacacttgctttccacttgacttcacgcgatggagagccgcgcatgattgtggggaagaatgaaagagggaaatccctactttttaagacagctactggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcagctgaaggagcttggagacaagtcgagaaggtagagacatgggctcttaggcacccaggtttcaccatactagctctatttcttgctcattacataggcacttccctgatccagaaagtggtcatttttatactactaatgctggtcactccatccatgacaatgagatgcgtgggagtaggaaacagagattttgtggaaggtctgtcaggagctacgtgggttgatgtggtgctagagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatacgagaacctcaaatacactgtcatcatcacagtgcacacaggagaccaacaccaggtgggaaatgacacacagggagtcacggttgagataacaccccaggcatcaaccgttgaagctgtcttgcctgagtatggaacccttgggctggaatgctcaccacggacaggcttggatttcaatgaaatgattttattgacaatgaagaacaaagcctggatggtacataggcaatggttctttgacctacccctaccatggacatcaggagcaacaacagagacaccaacttggaacaggaaagagcttctcgtaacattcaaaaatgcacatgcaaaaaagcaagaagtagttgtccttggatcgcaagagggagcaatgcacacagcgctgacaggagctacggagattcaaaactcaggaggtacaagcattttcgcggggcacttgaaatgtaggcttaagatggacaaattggaactcaaggggatgagctatgcaatgtgcttgaatacctttgtgttgaagaaagaagtctccgagacgcagcatgggacaatactcattaaggttgagtacaaaggggaagatgcaccttgcaagattcctttctccacagaggatggacaagggaaagcccacaatggtagactgattacagccaacccagtggtgaccaagaaggaggagcctgtcaacattgaggctgaacctccttttggggaaagcaacatagtgattggaattggagaaaaagccttgaaaattaactggtacaagaagggaagctcgattgggaagatgtttgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaatcacaggcccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagctgatacacgagtggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtactgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcactagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacgcacctaaaaggaggagctggccactgaatgagggagtgatggctgtcgggcttgtgagcattctggctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgctggtctggcatacttggcaaaagcaaacccaaagatctggcgttctatgggacgtacccagccccccagaaacacagaaagcagaactggaagagggggtctataggatcaaacaacaaggaatctttgggaaaacccaagtgggggttggagtgcagaaagaaggagtcttccacaccatgtggcacgtcacaagaggggcagtgttgacgcacaatgggaaaagactggaaccaaactgggcaagtgtgaaaaaagacctgatttcatacggaggaggatggagattgagcacacaatggcaaaaaggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggattgtatggcaatggagtggttacaaaaaatggtggctacgtcagtggaatagcgcaaacaaatgcagaaccagacggaccgacaccggaattggaagaagaaatgtttaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataagatatcaaacaaccgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcgtggaattcaggcaatgaatggattaccgactttgttgggaagacggtgtggtttgtccctagcatcaaagccggaaatgacatagcaaactgcctgcgaaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggccggaccaatgccagtcaccgcagcaagcgctgcgcaaaggagagggagagttggcaggaacccacaaaaagaaaatgaccagtacatattcacgggccagcctcttaacaatgacgaagaccatgctcactggacagaagcaaaaatgctgctagacaacatcaacacaccagaagggatcataccagctctctttgaaccagagagggagaagtcagccgccatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataaccaaattttagaggagaacatggatgtggaaatctggacaaaggaaggagaaaggaaaaaattgagacctaggtggcttgatgcccgcacttattcagatcccttagcactcaaggaattcaaggattttgcagctggcaggaagtcaattgcccttgatcttgtgacagaaataggaagagtgccttcacacttggcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttggtatcaggtaaagggattggaaagactacaataggactcatttgtgttattgtttccagtggcatgttatggatggctgatatcccacttcaatggatcgcgtcggctatagtcctggaatttttcatgatggtgttgctcataccagaaccagaaaaacaaagaactccccaagacaaccaactcgcatatgtcgtgataggcatactcacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtagccacaacagtaataacaccaatgttgagacataccatagagaattccacagcaaatgtgtccttggcagccatagctaaccaggcagtggtcctgatgggtttagacaaaggatggccaatatcgaaaatggacttaggcgtaccgctactggcactgggctgctattcacaagtgaacccactgactctcacagcggcagtacttctgctagtcacacattatgccattataggtccaggattgcaggctaaagccactcgtgaagctcaaaaaagaacagctgctggaataatgaagaatccaacagtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctatctagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaaccataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtattcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcgaaaggcagtagagctatatggtacatgtggctgggagctaggttccttgagttcgaagcactcggatttttaaatgaagaccactggttctcgcgtgaaaactcttacagtggagtagaaggagaaggactgcacaagctgggatacattttaagagacatctctaagatacccggaggagccatgtatgctgatgacacagctggttgggacacaagaataacagaagatgacttgcacaatgaggaaaaaatcacacagcaaatggaccctgaacacagacaattagcgaacgccatattcaagctcacataccaaaacaaagtggtcaaagtacaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaagacagacctcgagaaccctcatctgttagagaagaaaatcacacaatggttggaaaacaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaagtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactggcatccaacgccatttgttcagcagtgccagtccattgggtccctacgagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7331 - RNA, 9873 nt, synthetic construct
  misc_feature 1..9873: note = derived and/or modified CDS sequence (wt) from DENV-3__FJ639723__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacagctactggaatcaacatgtgcacactcatagctatggacttgggagagatgtgtgatgacacggtcacttataaatgccccctcattgccgaagtggaacctgaagacattgactgctggtgcaaccttacatcggcatgggtgacttacggaacgtgcaatcaagctggggagcatagacgtgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctatttcttgctcattacataggcacttccctgatccagaaagtggtcatttttatactactaatgctggtcactccatccatgacaatgagatgcgtgggagtaggaaacagagattttgtggaaggtctgtcaggagctacgtgggttgatgtggtgctagagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaggcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaacctcaaatacactgttatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaagaacaaagcctggatggtacataggcaatggttctttgacctacccctaccatggacatcaggagcaacaacagagacaccaacttggaacaggaaagagcttcttgtaacattcaaaaatgcacatgcaaaaaagcaagaagtagttgtccttggatcgcaagagggagcaatgcacacagcgctgacaggagctacggagattcaaaactcaggaggtacaagcatttttgcggggcacttgaaatgtaggcttaagatggacaaactggaactcaaggggatgagctatgcaatgtgcttgaatacctttgtgttgaggaaagaagtctccgagacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgtttgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacttggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagccggtcccatttcacaacacaatcataggcccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagctgatacacgaatggtgttgccgctcatgcacacttcctcccttgcgatacatgggagaggacggctgctggtatggcatggaaattagacctaccaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgtcgggcttgtgagcattctggctagttctctccttaggaatgatgtgcccatggctggaccattagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatctttgggaaaacccaagtgggggttggagtgcagaaagaaggagtcttccacaccatgtggcacgtcacaagaggggcagtgttgacgcacaatgggaaaagactggaaccaaactgggcaagtgtgaaaaaagatctgatttcatacggaggaggatggagattgagcacacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctatgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataagatatcaaacaactgcaacaaaatctgaacacacaggaagggagattgttgatttaatgtgccacgcaacattcacaatgcgcttgctatcaccagtcagggttccaaattacaatctgataataatggatgaggcccatttcacagatccagccagtatagcggctagagggtacatatcaacccgtgtaggaatgggagaggcagctgcaattttcatgacagcaacaccccctggaactgctgaagcctttccccagagcaacgctccaattcaagatgaagaaagggatattccggaacgctcgtggaactcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggccggaccaatgccagtcaccgcagcaagcgctgcgcaaaggagagggagagttggcaggaacccacaaaaagaaaatgaccagtacatattcacgggccagcctcttaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcctataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcggatcccttagcactcaaggaattcaaggattttgcagctggcaggaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagactacaataggactcatttgtgttattgtttccagtggcatgttatggatggctgatatcccacttcaatggatcgcgtcggctatagtcctggaattttttatgatggtgttgctcataccagaaccagaaaaacaaagaactccccaagacaaccaactcgcatatgtcgtgataggcatactcacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacttaggcgtaccgctactggcactgggctgctattcacaagtgaacccactgactctcacagcggcagtacttctgttagtcacacattatgccattataggtccaggattgcaggctaaagccactcgtgaagctcaaaaaagaacagctgctggaataatgaagaatccaacggtggatgggataatgacaatagacctagatcctgtgatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctatttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagtcacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaaccataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtactggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtatttaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaacttcacaaattgggcaagtgtggaagctgcgtctacaacatgatgggcaagagagagaagaaacttggagagtttggcaaagcaaaaggcagtagagctatatggtacatgtggttgggagctaggttccttgagttcgaagcactcggatttttaaatgaagaccactggttctcgcgtgaaaactcttacagtggagtagaaggagaaggactgcacaagctgggatacattttaagagacatctctaagatacccggaggagccatgtatgctgatgacacagctggttgggacacaagaataacagaagatgacctgcacaatgaggaaaaaatcacacagcaaatggaccctgaacacagacaattagcgaacgccatattcaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgttagagaagaaaatcacacaatggttggaaaacaaaggagtggagagattaaaaagaatggccatcagcggggatgattgcgtggtgaaaccgatcgatgacaggtttgctaatgccctgcttgccctgaacgacatgggaaaggttaggaaggacatacctcaatggcagccatcaaaggggtggcatgattggcaacaagtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcttacgctcaaatgtggagtctcatgtattttcacagaagagatcttagactggcatccaacgccatttgttcagcagtgccagtccattgggtccctacgagcagaacgacatggtctattcacgctcaccatcagtggatgactacagaagacatgcttgctgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagaaggagccatttggtaa

SEQ ID NO: 7332 - RNA, 9873 nt, synthetic construct
  misc_feature 1..9873: note = derived and/or modified CDS sequence (wt) from DENV-3__FJ639724__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacctataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaagggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtcctatttcacaacacaaccacaggcccgggtaccacacccaaacgacaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagacatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattgctaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcaccctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagactagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaaccacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagccctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatctgggagcaggaactcgacatgtcaatgcggaaccagaaacacccaacatggatgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttccaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7333 - RNA, 9873 nt, synthetic construct
  misc_feature 1..9873: note = derived and/or modified CDS sequence (wt) from DENV-3__FJ639725__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacctatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatctttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaagaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggatttttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagaccccgccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgaggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacatctagcccacagaacgagaaacgccctggacaacttggtgatgctgcatacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgcttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagtcacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagatttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaatatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccattcgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggggccaggtaccttgagttcgaagcactcggatttttaaatgaagaccactggttctcgcgtgaaaactcttacagtggggtagaaggagaaggactgcacaagttgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagggaagaaaatcacacaatggttggaaaccaaaggagtggagagattaaaaagaatggccatcagcggggatgattgcgtggtgaaaccgatcgatgacaggtttgccaatgccttgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccccacaagcagaacgacatggtctattcacgctcaccatcagtggatgactacagaagacatgcttactgtctggaacagggtgtggatagaggacaatccatggatggaagacaaaactccagtcacaacttgggaagatgttccatacctaggaaagagagaagatcaatggtgcggatcactcattggtctcacttccagagcaacctgggcccagaacatactcacagcaatccaacaggtgagaagccttataggcgatgaagaatttctggactacatgccttcgatgaagagatttaggaaggaggaggagtcagagggagccatttggtaa

SEQ ID NO: 7334 - RNA, 9873 nt, synthetic construct
  misc_feature 1..9873: note = derived and/or modified CDS sequence (wt) from DENV-3__FJ639726__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaagggtagagacatgggctcttaggcacccaggtttcaccatactagctctatttcttgcccattacataggcacttccctgacccagaaagtggtcatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcccacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtacaccaaatattcggaagtgcttacacagccctgtttagcggagtctcatggataatgaaaattggaataggtgtcctcttaacctggataggattgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggcgtactagagagtgacatgatcatcccaaagagtctagctggtcctatttcacaacacaaccacaggcccgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagacatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattttggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtaatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacgtggcaaaagcaaacccaaagatctggcgttctatgggacgtacccagccccccagaaacacagaaagcagaactggaagagggggtctataggatcaaacaacaaggaatttttgggaaaacccaagtgggggtaggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcccatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcaccctgggtcaggaaagacgcggaaatatcttccagccatcgtcagagaagcaatcaagagacgcttaagaactctaattttggcaccaacaagagtggttgctgctgagatggaagaagcactgaaaggactcccaataaggtatcaaacaaccgcaacaaaatctgaacacacaggaagggagattgttgatctaatgtgccacgcaacattcacaatgcgcctactatcaccggtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaaccacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttgatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggctagctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatctttcacctgaaaagtgtgacaccctattgtgtgacattggagaatcttcaccaagcccaacagtggaagaaagcagaactataagagttttgaagatggttgagccatggctaagaaacaaccagttttgcatcaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcagggactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7335 - RNA, 9873 nt, synthetic construct
  misc_feature 1..9873: note = derived and/or modified CDS sequence (wt) from DENV-3__KF955333__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcttcaaccgttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgcgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttaggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggatggctgctggtatggcatggaaattagacctatcaatgagaaagaagagaacatggtaaagtctttagtctcagcggggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagagaagccagcagatgtaccatgggaggaagaggctgagcaaacaggagtgtcccacaatttgatgatcacagttgatgatgatggaccaatgagaataaaggatgatgagactgagaacatcctaacagtgctcttaaaaacagcattactaatagtatcaggcatctttccgtactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgaacgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtaccaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaacaatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttggcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatctcggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcctatggtgacacagatggcaatgacagatacaactccatttgggcagcaaagagtttttaaagagaaagtggacaccaggacacccaggcccatgccagggacaagaaaggttatggagattacagcggaatggctttggagaaccctgggaaggaacaaaaaacccagattgtgcacaagagaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacagcgcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgactggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7336 - RNA, 9873 nt, synthetic construct
  misc_feature 1..9873: note = derived and/or modified CDS sequence (wt) from DENV-3__GQ868628__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattatataggcacttccctgacccagaaagtggttatttttatactactaatgctggtcactccatccatgacaatgagatgcgtgggagtagggaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacgggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgcaagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtgcttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctcctcctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattttggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcttgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgccctcgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttactaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaaggataaaaaggatcaaggaggagcatagttcaacatggcactatgatgatgaaaatccttataaaacgtgggcttaccatggatcctatgaagtcaaagccactggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaggtggtcaaagttcaacgaccaactccaaaaggcacggtaatggacatcatatctaggaaagaccaaagaggcagtggacaggtggggacttatggtctgaacacatttaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaagggtggcatgattggcaacaggtccctttctgctcccaccactttcatgaactgatcatgaaagacggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7337 - RNA, 9873 nt, synthetic construct
  misc_feature 1..9873: note = derived and/or modified CDS sequence (wt) from DENV-3__FJ639727__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgagaaccttaaatacactgtcatcatcacggtgcacacaggagaccaacaccaggtgggaaatgatacgcagggagtcacggttgagataacaccccaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagaaggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaatcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctactgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagactacgggtttggagtcttcacaaccaacatatggctgaaactccgagaggtgtacacccaatcatgtgatcataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacatactctttggagcaatggtgtactagagagtgacatgatcatcccaaagagtctagctggtcctatttcacaacacaaccacaggcccgggtactacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggctctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaatttttacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgaaaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaacctaactataatggatcttcatcccgggtcaggaaagacgcggaaatatcttccagccatcgtcagagaagcaatcaagagacgcttaagaactctaattttggcaccaacaagagtggttgcagctgagatggaagaagcactgaaaggacttccaataaggtaccaaacaactgcaacaaaatctgaacacacaggaagggagattgttgatctaatgtgccacgcaacattcacaatgcgcttattatcaccagtcagggttccaaattacaatttggtagtaatggatgaggcccatttcacagacccagccagtatagcggctagagggtacatatcaactcgtgtaggaatgggagaggcagctgcaattttcatgacagcaacaccccctggaactgctgaagcctttcctcagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatgggaaaaaggtcatccaacttagtaggaagacctttgatacagaatatcaaaagaccagactgaatgattgggacttcgtggtgacaacagacatttcagaaatgggagctaactttagagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgagccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgccctcgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatactcacactggctgcgatagtagcagctaatgaaatgggattattggaaaccacaaagagagatttaggaatgtctaaagaaccaggtgttgtttccccaaccagctatttagatgtagacttgcacccagcatcagcctggacattgtacgccgtggccacaacagtaataacaccaatgttgagacataccatagagaattccacagcaaatgtctccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattgaacccttacatgccaactgtgattgagcacctagaaagactacaaagaaaatatggaggaatgcttgtgagaaacccactctcacgaaactccacgcatgaaatgtactggatatccaatggtaccggcaacatcgtctcatcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggactcccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagactaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7338 - RNA, 9873 nt, synthetic construct
  misc_feature 1..9873: note = derived and/or modified CDS sequence (wt) from DENV-3__GQ868629__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttacttttcaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtagggaacagagattttgtggaaggtctatcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaagggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacgggcttggatttcaatgaaatgattttattgacaatgaaaaacaaagcctggatggtacataggcaatggttctttgacctacccctaccatggacatcaggagctataacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatctttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgctagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctcctcctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaattgataacacaatttgagacatatcagttgtggacggcattagtctccttaacatgttctaacacaattttcacgttgactgttgcctggaggacagccaccttgattttggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggatgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggatcaccgactttgttgggaagacggtgtggtttgtccctagcatcaaagccggaaatgacatagcaaactgcttgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgccctcgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttactaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaaggataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaggtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgaggagccttataggcgatgaagaatttctggactacatgccttcgatgaagagattcaggaaggaggaggagtcagagggagccatttggtaa

SEQ ID NO: 7339 - RNA, 9873 nt, synthetic construct
  misc_feature 1..9873: note = derived and/or modified CDS sequence (wt) from DENV-3__FJ639728__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtagggaacagagattttgtggaaggtctgtcaggagctacgtgggttgatgtggtgctcgagcacggtgggtgtgtgaccaccatggctaagagcaagcctacgttggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacgggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgctagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgccttaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctcctcctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattttggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagccgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcttgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgatccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgccctcgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttactaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgttactgaacagatttacgatgacacacaggagacccaccatagagaaagatgtggatttgggagcaggaactcgacatgtcaatgcggaaccagaaacacccaacatggacgtcattggagaaaggataaaaaggatcaaggaggagcatagttcaacatggcactatgatgatgaaaatccttataaaacgtgggcttaccatggatcctatgaagtcaaagccacaggctcagcctcctctatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaggtggtcaaagttcaacgaccaactccaaaaggcacggtaatggatatcatatctaggaaagaccaaagaggcagtggacaggtggggacttatggtctgaacacattcaccaacatggaagcccagttagtcagacagatggaaggagaaggtgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7340 - RNA, 9873 nt, synthetic construct
  misc_feature 1..9873: note = derived and/or modified CDS sequence (wt) from DENV-3__FJ639729__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtagggaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaagggaagcttggtgacatgcgcgaaatttcaatgtctagaaccaatagagggaaaagtggtgcaatatgagaaccttaaatacactgttatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacgggcttggatttcaatgaaatgattttattgacaatgaaaaacaaagcctggatggtacataggcaatggttctttgacctacccctaccatggacatcaggagctataacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatctttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggagagcaacatagtgattggaattggagacaaagccttgaaaattaactggtacaagaagggaagctcgattgggaagatgttcgaggccactgctagaggtgcaaggcgcatggccatcttgggagacacagcctgggactttggttcagtgggtggtgttctaaattcattagggaaaatggtgcaccaaatattcggaagtgcttatacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaactaacatatggctgaaactccgagaggtgtatacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggactttaactattgtgaaggaacaacagtagtcatcacagaaaactgtgggacaagaggcccatcattgagaacaacaacagtgtcaggaaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaattcgggaaaaaacacatgattgcaggggttctcttcacgtttgtgctcctcctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattttggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcgtggaattcaggcaatgaatggatcaccgactttgttgggaagacggtgtggtttgtccctagcatcaaagccggaaatgacatagcaaactgcttgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgccctcgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttactaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatatggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaaggataaaaaggatcaaggaggagcatagttcaacatggcactatgatgatgaaaatccttataaaacgtgggcttaccatggatcctatgaagtcaaagctacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagctaggtaccttgagttcgaagcactcggatttttaaatgaagaccactggttctcgcgtgaaaactcttacagtggagtagaaggagaaggactgcataagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaggtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggaatctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7341 - RNA, 9873 nt, synthetic construct
  misc_feature 1..9873: note = derived and/or modified CDS sequence (wt) from DENV-3__FJ639730__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggagagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggcttgtttggaaaaggaagcttggtgacatgtgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcttcaaccgttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagaaggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttaggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggtacgtcagcagacctcactgtagagaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccgtactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagattggaaccaaactgggccagcgtgaaaaaagatctgatttcatacggaggaggatggagattgaacgcacaatggcaaaagggagaagaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacaaagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacatacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttaacagatggacccgagcgagtgatcctggctggaccaatgccagtcaccgcagcgagcgctgcgcaaaggagagggagagttggcaggaacccacaaaaggaaaatgaccagtacatatttacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttggcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaaacaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttccatcatgaaatcagttggaacaggaaggagaggaacggggtcacaaggcgaaaccttaggagaaaagtggaaaaagaaattaaatcagttatcccggaaagagtttgagctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagtccaacagtggaagaaagcagaactataagagttttgaagatggttgagccatggctaagaaacaaccagttttgcattaaagtattaaacccttacatgccaactgtgattgagcacctagaaaaactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtttttaaagagaaagtggacactaggacacccaggcccatgccagggacaagaaaggttatggagattacagcggaatggctttggagaaccctgggaaggaacaaaaaacccagactgtgcacaagagaagagttcacaaaaaaggtcagaaccaacgcggctatgggagcagttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgatctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgactggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatctaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7342 - RNA, 9873 nt, synthetic construct
  misc_feature 1..9873: note = derived and/or modified CDS sequence (wt) from DENV-3__KF955464__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgatcctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgagaaccttaaatacactgtcatcatcacagtgcacacaggagaccaacaccaagtgggaaatgacacgcagggagtcacggttgagataactccccaggcatcaaccgttgaagctgtcttgcccgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaaacatttttgcggggcatttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctatcaacattgaggctgaacctccttttggggaaagcaacatagtgattggaattggagacaaagccttaaaaattaactggtacaagaagggaagctcgattgggaagatgttcgaggcgactgccagaggtgcaaggcgcatggccatcttgggagacacagcttgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaggctgacatggggtgcgtcataaactggaaaggaaaagaactcaaatgtggaaatggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtcctatttcacaacacaaccataggcccgggtaccacacccaaacggcaggaccttggcacttgggaaaattggagctggactttaactattgtgaaggaacaacagtagtcatcgcagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctctttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaagagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacgacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccaacaccggaactggaagaagaaatgttcaaaaagcgaaatctaactataatggatcttcatcctgggtcaggaaagacgcggaaatatcttccagctatcgtcagagaagcaatcaagagacgcctaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttgataataatggatgaggcccatttcacagacccagccagtatagcggctagagggtacatatcaactcgtgtaggaatgggagaggcagctgcaattttcatgacagcaacaccccctggaactgctgaagcttttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggccgcgatagtagcagctaatgaaatgggattattggaaaccacaaagagagatctaggaatgtctaaagaaccaggtgttgtttctccaaccagctatttagatgtagacttgcacccagcatcagcctggacattgtacgccgtggccacaacagtgataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatctacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttgtcccggaaagagtttgacctttacaagaaatctggaatcactgaagtggatagaacagaagccaaagaagggttgaaaagaggagaaacaacacatcatgctgtgtccagaggcagcgcaaaacttcaatggttcgtggagaggaacatggtcattcccgaaggaagagtcatagacttaggctgtggaagaggaggctggtcatattattgcgctggactgaaaaaagttacagaagtgcgagggtacacaaaaggcggcccaggacacgaagaaccagtacctatgtctacatacggatggaacatagtcaagttaatgagtggaaaggacgtgttctatcttccacctgaaaagtgtgacaccctattgtgtgacattggagaatcttcaccaagcccaacagtggaagaaagcagaactataagagttttgaggatggttgagccatggctaagaaacaaccagttttgcattaaagtattaaacccttacatgccaaatgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatctgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagacacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatattcaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcggaggcagacctcgagaaccctcatctgctagagaagaaaatcacacaatggttggaaaccaaaggagtggagagattaaaaagaatggctatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcttacgctcaaatgtggagtctcatgtattttcacagaagagatcttagactagcatccaacgccatttgttcagcagtaccagcccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaattcctggactacatgccttcgatgaagagattcaggaaggaggaggagtcagagggagccatttggtaa

SEQ ID NO: 7343 - RNA, 9873 nt, synthetic construct
  misc_feature 1..9873: note = derived and/or modified CDS sequence (wt) from DENV-3__FJ639731__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggagagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacctccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgtgcgaaatttcaatgtctagaaccaatagagggaaaagtggtgcaatatgagaaccttaaatacactgtcatcatcacagtgcacacaggggaccaacaccaggtgggaaatgacacgcagggagtcacggttgagataacaccccaggcttcaaccgttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagatccaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacagtactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacctccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcttcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttaggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaagatggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcaaatggaattgctctggggctcatgactctaaaactgataacacaatttgagacatatcagttgtggacggcattagtctccttaacatgttctaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagagaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccgtactccatacccgccacactgttggtctggcatacctggcaaaagcaaacccaaagatctggcgttctatgggacgtacccagccccccagaaacacagaaagcagaactggaagagggggtctataggatcaaacaacaaggaatttttgggaaaacccaagtgggggttggggtgcagaaagaaggagttttccataccatgtggcacgtcacaagaggggcagtattgacgcacaatgggaaaagactggaaccaaactgggccagcgtgaaaaaagatctgatttcatacggaggaggatggagattgaacgcacaatggcaaaagggagaagaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacaaagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttgagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggttcgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttaacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttggcccacagaacgagaaacgccctggacaacctggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaaacaactaggacaggtcatgctcttggttttgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtttttaaagagaaagtggacactaggacacccaggcccatgccagggacaagaaaggttatggagattacagcggaatggctttggagaaccctgggaaggaacaaaaaacccagactgtgcacaagagaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgatctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaagcagacctcgagaaccctcatctgctagagaagaaaatcacacaatggttggaaaccaaaggagtggagagattaaaaagaatggccatcagcggggatgattgcgtggtgaaaccgattgatgacaggtttgccaatgccctgcttgccctgaacgacatgggaaaggttaggaaggacataccccaatggcagccatcaaaggggtggcatgactggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttctagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7344 - RNA, 9873 nt, synthetic construct
  misc_feature 1..9873: note = derived and/or modified CDS sequence (wt) from DENV-3__HM181933__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcatcgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgtgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcttcaaccgttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttaggaaaattggagctggactttaactattgtgaaggaacaacagtagtcatcacagaaaactgtgggacaagacgcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagagaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccgtactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgaacgcacaatggcaaaagggagaagaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttggcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagataaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaaacaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaaccagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcccatggtgacacagatggcaatgacggatacaactccatttgggcagcaaagagtttttaaagagaaagtggacaccaggacacccaggcccatgccagggacaagaaaggttatggagattacagcggaatggctttggagaaccctgggaaggaacaaaaaacccagattgtgcacaagagaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgatctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcacctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgactggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7345 - RNA, 9873 nt, synthetic construct
  misc_feature 1..9873: note = derived and/or modified CDS sequence (wt) from DENV-3__JF295012__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgtactctcatagctatggacttgggagagatgtgtgatgacacggtcacttataaatgccccctcattgctgaagtggaacctgaagacattgactgctggtgcaaccttacatcgacatgggtgacctatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattatataggcacttccctgacccagaaagtggttatttttatactactaatgctggtcactccatccatgacaatgagatgcgtgggagtagggaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacgggcttggatttcaatgaaatgattttattgacaatgaaaaacaaagcctggatggtacataggcaatggttctttgacctacccctaccatggacatcaggagctacaacagagacaccaacttggaacaagaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgctagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacattaacaccacagcccatggagctaaaatattcatggaaaacatggggaaaggcaaaaatagtgacagctgaaacacaaaattcctcattcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacttgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctcctcctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattttggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctatagaatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgttggaatgggagaggcagccgcaatcttcatgacagcaacaccccctggaacagctgatgcctttcctcagagcaacgctccaattcaagatgaagaaagggacataccagaacgctcatggaattcaggcaatgaatggattaccgacttcgctgggaaaacggtgtggtttgtccctagcattaaagccggaaatgacatagcaaactgcttgcgaaaaaacgggaaaaaagtcattcaacttagtaggaagacttttgacacagaatatcagaagactaaactgaatgattgggactttgtggtgacaactgacatttcagaaatgggggccaattttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagacagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaatttaaggattttgcagctggcagaaagtcaatcgccctcgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttactaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcaccaggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtccagaggcagcgcaaaacttcaatggttcgtggagaggaatatggtcattcccgaaggaagagtcatagacttaggctgtggaagaggaggctggtcatattattgcgcaggactgaaaaaagttacagaagtgcgaggatacacaaaaggcggcccaggacacgaagaaccagtacccatgtctacatacggatggaacatagtcaagttaatgagtggaaaggatgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaaggataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccaggttgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgggaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatattcaagctcacataccaaaacaaggtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaagggtggcatgattggcaacaggtccctttctgctcccaccactttcatgaactgatcatgaaagacggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7346 - RNA, 9873 nt, synthetic construct
  misc_feature 1..9873: note = derived and/or modified CDS sequence (wt) from DENV-3__FJ898463__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggttacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcgactgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctctacagaggatggacaagggaaagctcacaatggcagactgattacagccaacccagtggtgactaagaaggaggagcctgtcaatattgaggctgaacctccttttggggaaagtaatatagtgattggaattggagacaacgccttaaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacattaacaccacaacctatggagctaaaatactcatggaaaacgtggggaaaggcaaaaatagtgacagctgaaacacaaaattcttctttcataatagacgggccaaacacaccggagtgtccaagtgcctcaagagcatggaatgtgtgggaggtggaagattacgggttcggagtcttcacaaccaacatatggctgaaacttcgagaggtgtacacccaactatgtgaccataggctaatgtcggcagctgttaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggccggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggtgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaattgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactctttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggttcgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaactcacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgaccttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccaccacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaagtcatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggacagaacagaagccaaagaagggttgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggacaaccttgggaaggaacaaaaaacccaggttatgcacaagggaagagtttacaaaaaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggtagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttggcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7347 - RNA, 9873 nt, synthetic construct
  misc_feature 1..9873: note = derived and/or modified CDS sequence (wt) from DENV-3__GQ868616__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggttacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcgactgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctctacagaggatggacaagggaaagctcacaatggcagactgattacagccaacccagtggtgactaagaaggaggagcctgtcaatattgaggctgaacctccttttggggaaagtaatatagtgattggaattggagacaacgccttaaaaatcaactggtataagaaaggaagctctatcgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcatcacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacattaacaccacaacctatggagctaaaatactcatggaaaacgtggggaaaggcaaaaatagtgacagctgaaacacaaaattcttctttcataatagacgggccaaacacaccggagtgtccaagtgcctcaagagcatggaatgtgtgggaggtggaagattacgggttcggagtcttcacaaccaacatatggctgaaacttcgagaggtgtacacccaactatgtgaccataggctaatgtcggcagctgttaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggccggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggtgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaattgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactctttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggttcgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaactcacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgaccttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagccctagatcctgtaatatatgattcaaaatttgaaaagcaactgggacaagtcatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggacagaacagaagccaaagaagggttgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacccagatggcaatgacagatacaactccatttggccagcagagagtctttaaagagaaagtggacaccaggacacccaggtccatgccaggaacaagaagggtcatggggatcacaccggagtggctctggagacccttgggaaggaacaaaaaacccaggttatgcccaagggaagagtttacaaaaaaggtcagaactaacgcacccatgggcgccgttttcacagaggagacccaatgggccagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggtagtagagctatatggtacatgtggttgggagccaggtaccttgagttcgaagcccttggattcttaaatgaagaccactggttctcgcgtgagaactcttacagtggagtggaaggagaaggactgcccaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttggcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7348 - RNA, 9873 nt, synthetic construct
  misc_feature 1..9873: note = derived and/or modified CDS sequence (wt) from DENV-3__GQ199887__SS-prME
  source 1..9873: mol_type = other RNA
acatcactctgtctcatgatgatattgccagcagcacttgctttccacttgacttcacgagatggagagccgcgcatgattgtggggaagaatgaaagaggaaaatctctactttttaagacagcctctggaattaacatgtgcacactcatagccatggacttgggagaaatgtgtgatgacacggtcacttacaaatgcccccacattaccgaagtggaacctgaagacattgactgctggtgcaaccttacatcgacatgggtgacttatggaacgtgcaatcaagctggagagcacagacgcgacaagagatcagtggcgttagctccccatgttggcatgggactggatacacgcacccaaacctggatgtcggctgaaggagcttggagacaagtcgagaaggtagagacatgggcccttaggcacccagggttcaccatactagccctatttcttgcccattatataggcacttccttgacccagaaggtggtcattttcatactactaatgctggtcaccccatccatgacaatgagatgtgtgggagtaggaaacagagattttgtggaaggtttatcaggagctacgtgggttgacgtggtgcttgagcacggtgggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcggtcttgcctgaggagcaggaccagaactacgtgtgtaagcatacatacgtagacagaggctgggggaacggttgtggtttgtttggcaagggaagcttggtaacatgtgcgaaatttcaatgcctggaatcaatagagggaaaagtggtgcaatatgagaacctcaaatacaccgtcatcattacagtgcacacaggagaccaacaccaggtgggaaatgaaacgcagggagtcacggctgagataacacctcaggcatcaaccactgaagccatcttgcctgaatatggtacccttgggctagaatgctcaccacggacaggtttggatttcaatgaaatgatcttactaacaatgaagaacaaagcatggatggtacatagacaatggttctttgacctacctctaccatggacatcaggagctacaacagaaacaccaacctggaacaggaaggagcttcttgtgacattcaaaaacgcacatgcgaaaaaacaagaagtagttgtccttggatcgcaagagggagcaatgcatacagcactgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcgttaaagtcgagtacaaaggggaagatgcaccttgcaagattcctttctccacagaggatggacaagggaaagctcacaatggcagactgatcacagccaacccagtggtgactaagaaggaggagcctgtcaatattgaggctgaacctccttttggggaaagtaatatagtaattggaattggagacaacgccttgaaaatcaactggtacaagaagggaagctcgattgggaagatgttcgaggccactgccagaggtgcaaggcgcatggccatcttgggagacacagcctgggactttggatcagtgggtggtgttctgaactcattgggcaaaatggtgcaccaaatatttggaagtgcttacacagccctattcagtggagtctcttgggtgatgaaaattggaataggtgtcctcttgacttggatagggttgaattcaaaaaacacatccatgtcattttcatgcattgcgataggaatcattacactctatctgggagccgtggtacaagctgacatggggtgtgtcataaactggaaaggcaaagaactcaaatgtggaagtggaattttcgtcaccaacgaggtccatacctggacagagcaatacaaattccaagcagactccccaaaaagattggcgacagccattgcaggcgcttgggagaatggagtatgcggaatcaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatattcatggaaaacgtggggaaaggcaaaaatagtgacagctgaaatacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccttcatagaggtgaaaacctgcacatggccaaaatcacacaccctttggagcaatggtgtgctagagagtgacatgatcatcccaaagagtctagctggtcctatttcgcaacacaactacaggcccgggtatcacacccaaacggcaggaccctggcacttaggaaaattggagctggacttcaactattgtgaaggaacaacagttgtcatcacagaaaactgtgggacaagaggcccatcattgagaacaacaacagtgtcagggaagttgatacacgaatggtgttgccgctcgtgcacacttcctcccctgcgatacatgggagaagacggctgctggtatggcatggaaattagacccatcagtgagaaagaagagaacatggtaaagtctttagcctcagcagggagtggaaaggtggacaacttcacaatgggtgtcttgtgtttggcaatcctctttgaagaggtgatgagaggaaaatttgggaagaaacacatgattgcaggggttttcttcacgttcgtgctccttctctcggggcaaataacatggagagacatggcgcacacactcataatgatagggtccaacgcctctgacaggatgggaatgggcgtcacttacctagctttaattgcaacgtttaaaatccagccattcttggctttgggatttttcctaagaaaactgacatctagagaaaatttattgttaggagttgggttggctatggcaacaacgctgcaactgccagaggacattgaacaaatggcaaatggaatcgctctggggctcatggctcttaaactgataacacaatttgaaacataccaattatggacggcattagtctccttaacgtgctcaaatacaatgtttacgttgactgttgcctggagaacagccaccctgattttggccggagtttcgcttttaccagtgtgccagtcttcgagcatgaggaaaacagactggctcccaatgactgtggcagctatgggagttccacccctaccactttttatttttagcttgaaagacacactcaaaaggagaagctggccactgaatgagggggtgatggctgttgggcttgtgagcattctggccagttctctccttaggaatgatgtgcccatggctggaccattagtggccgggggcttgctgatagcgtgctacgtcataaccggcacgtcagcagacctcactgtagaaaaagcagcggatgtaacatgggaggaagaggctgagcaaacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcatacttggcaaaagcaaacccaaagatccggcgttctatgggacgtacccagccccccagagacacagaaagcagaactggaagaaggggtctataggatcaaacagcaaggaatcctcgggaaaacccaagtaggggttggagtacagaaagaaggagtcttccacaccatgtggcacgtcacaagaggggcagtgttgacacataatgggaaaagactggaaccaaactgggctagcgtgaaaaaagatctgatttcatacggaggaggatggagattgagtgcacaatggcaaaagggggaggaggtgcaggttatcgctgtagagcctgggaagaacccaaagaactttcaaaccatgccaggcacttttcagactacaacaggggaaataggagcaattgcactggattttaagcctggaacttcaggatctcctatcataaacagagagggaaaggtagtgggactgtatggcaatggagtggttacaaagaatggtggctacgtcagcggaatagcgcaaacaaatgcagaaccagatggaccgacaccagagttggaagaagagatgttcagaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagttagggttccaaattacaacttgataataatggatgaggcccatttcacagacccagccagtatagcggctagagggtacatatcaactcgtgtaggaatgggagaggcagccgcaattttcatgacagcaacacctcctggaacagctgatgcctttcctcagagcaacgctccaattcaagatgaagaaagggacataccagaacgctcatggaactcaggcaatgaatggattaccgacttcgctgggaaaacggtgtggtttgtccctagcataaaagccggaaatgacatagcaaactgcttgcgaaaaaacgggaaaaaggtcattcaacttagtagaaagacctttgacacagaatatcagaagactaaactgaatgattgggacttcgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagatcatgctcactggacagaagcaaaaatgctgctggacaacatcaacacaccagaagggattataccagctctctttgaaccagaaagggagaagtcagccgccatagacggtgaataccgcctgaagggtgagtccaggaagactttcgtggaactcatgaggaggggtgaccttccagtttggttagcccataaagtagcttcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcctttagcactcaaggaattcaaggattttgcggctggcagaaagtcaatcgcccttgatcttgtgacagaaataggaagagtgccttcacacttagcccacagaacgagaaacgctctggacaatctggtgatgctgcatacgtcagaacatggcggtagggcctacaggcatgcggtggaggaactaccagaaacaatggaaacactcctactcttgggactcatgatcctgttgacaggtggagtaatgcttttcttgatatcaggtaaagggattggaaagacttcaataggactcatttgtgtaattgcttccagcggcatgttgtggatggccgatgtcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggactgttggaaactacaaagagagatttaggaatgtctaaagagccaggtgttgtttctccaaccagctatttggatgtggacttgcacccagcatcagcctggacattgtacgccgtggccactacagtaataacaccaatgttgagacataccatagagaattctacagcaaatgtgtccctagcagctatagccaaccaggcagtggtcctgatgggtttggacaaaggatggccaatatcaaaaatggacttaggcgtaccactactggcattgggttgctattcacaagtgaacccactgactctaacagcggcagtacttttgctaatcacacattatgctattataggtccaggattgcaagcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttattaatgagaacatcatgggccttgtgtgaagctctaaccctagctacaggaccaataacaacactctgggaaggatcacctgggaagttttggaacaccacgatagctgtttctatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatccggaatcactgaagtggatagaacagaagccaaagaagggctgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagttacagaagtgcgaggatacacaaaaggcggtccaggacacgaagaaccagtacctatgtctacatatggatggaacatagttaagttaatgagtggaaaggatgtgttttatcttccacctgaaaagtgtgataccctgttgtgtgacattggagaatcttcaccaagcccaacagtggaagaaagcagaactataagagttttgaagatggttgaaccatggctaaaaaacaaccagttttgcattaaagtattgaacccttacatgccaactgtgattgagcacctagaaagactacaaaggaaacatggaggaatgcttgtgagaaatccactttcacgaaactccacgcacgaaatgtactggatatccaatggtacaggtaacatcgtctcttcagtcaacatggtatctagattgctactgaacagattcacgatgacacacaggaggcccaccatagagagagatgtggatttaggagcaggaactcgacatgttaatgcggaaccagaaatacccaacatggatgtcattggggaaagaataaaaaggatcaaggaggaacataattcaacatggcactatgatgacgaaaacccctacaaaacgtgggcttaccatggatcctatgaagtcaaagccacaggctcagcctcctccatgataaatggagtcgtgaaactcctcactaaaccatgggatgtggtgcccatggtgacacagatggcaatgacagatacaaccccttttggccagcagagagtctttaaagagaaagtggacaccaggacacctaggcccatgccagggacaagaaaggttatggagatcacagcggagtggctctggagaaccctgggaaggaacaaaagacccaggttatgcacaagggaagagttcacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggatacatattaagagacatttccaagatacccggaggagctatgtatgctgatgacacagctggttgggacacaaggataacagaagatgacctgcacaatgaggaaaagatcacacagcaaatggaccctgaacacaggcagttagcgaacgctatattcaagctcacataccaaaacaaagtggtcaaagttcaacgaccgactccaacgggcacggtaatggacatcatatctaggaaagaccaaagaggcagtggacaggtgggaacttatggtctgaatacattcaccaacatggaagcccagttagtcagacaaatggaaggagaaggtgtgctgtcaaaggcagacctcgagaaccctcatctgctagagaagaaaattacacaatggttggaaaccaaaggagtggagaggttaaaaagaatggccattagcggggatgattgcgtagtgaaaccaatcgatgacaggttcgccaatgccctgcttgctctgaacgatatgggaaaggttaggaaagacatacctcagtggcagccatcaaagggatggcatgattggcaacaggttcccttctgctcccaccactttcatgaattgatcatgaaagatggaagaaagttggtggttccctgcagaccccaagatgaattaataggaagagcaagaatctctcaaggagcgggatggagccttagagaaactgcatgtctggggaaagcctatgcccaaatgtggagtctcatgtattttcacagaagagatctcagactagcatccaacgccatatgttcagcagtaccagtccattgggtccccacaagtagaacgacatggtctattcatgctcaccatcagtggatgactacagaagacatgcttactgtctggaacagggtgtggatagaggataatccatggatggaagacaaaactccagttacaacttgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcgatgaagagattcaggaaggaggaggagtcagagggagccatttggtaa

SEQ ID NO: 7349 - RNA, 9873 nt, synthetic construct
  misc_feature 1..9873: note = derived and/or modified CDS sequence (wt) from DENV-3__GQ199888__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatctctactttttaagacagcctctggaattaacatgtgcacactcatagccatggacttgggagaaatgtgtgatgacacggtcacttacaaatgcccccacattaccgaagtggaacctgaagacattgactgctggtgcaaccttacatcgacatgggtgacttatggaacgtgcaatcaagctggagagcacagacgcgacaagagatcagtggcgttagctccccatgttggcatgggactggatacacgcacccaaacctggatgtcggctgaaggagcttggagacaagtcgagaaggtagagacatgggcccttaggcacccagggttcaccatactagccctatttcttgcccattatataggcacttccttgacccagaaggtggtcattttcatactactaatgctggtcaccccatccatgacaatgagatgtgtgggagtaggaaacagagattttgtggaaggtttatcaggagctacgtgggttgacgtggtgcttgagcacggtgggtgtgtgactaccatggctaagaacaagcccacgctggatatagagcttcagaagaccgaggccacccaactggcgaccctaaggaagctatgcattgaggggaaaattaccaacataacaactgactcaagatgccctacccaaggggaagcggtcttgcctgaggagcaggaccagaactacgtgtgtaagcatacatacgtagacagaggctgggggaacggttgtggtttgtttggcaagggaagcttggtaacatgtgcgaaatttcaatgcctggaatcaatagagggaaaagtggtgcaatatgagaacctcaaatacaccgtcatcattacagtgcacacaggagaccaacaccaggtgggaaatgaaacgcagggagtcacggctgagataacacctcaggcatcaaccactgaagccatcttgcctgaatatggtacccttgggctagaatgctcaccacggacaggtttggatttcaatgaaatgatcttactaacaatgaagaacaaagcatggatggtacatagacaatggttctttgacctacctctaccatggacatcaggagctacaacagaaacaccaacctggaacaggaaggagcttcttgtgacattcaaaaacgcacatgcgaaaaaacaagaagtagttgtccttggatcgcaagagggagcaatgcatacagcactgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcgttaaagtcgagtacaaaggggaagatgcaccttgcaagattcctttctccacagaggatggacaagggaaagctcacaatggcagactgatcacagccaacccagtggtgactaagaaggaggagcctgtcaatattgaggctgaacctccttttggggaaagtaatatagtaattggaactggagacaacgccttgaaaatcaactggtacaagaagggaagctcgattgggaagatgttcgaggccactgccagaggtgcaaggcgcatggccatcttgggagacacagcctgggactttggatcagtgggtggtgttctgaactcattgggcaaaatggtgcaccaaatatttggaagtgcttacacagccctattcagtggagtctcttgggtgatgaaaattggaataggtgtcctcttgacttggatagggttgaattcaaaaaacacatccatgtcattttcatgcattgcgataggaatcattacactctatctgggagccgtggtacaagctgacatggggtgtgtcataaactggaaaggcaaagaactcaaatgtggaagtggaattttcgtcaccaacgaggtccatacctggacagagcaatacaaattccaagcagactccccaaaaagattggcgacagccattgcaggcgcttgggagaatggagtgtgcggaatcaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatattcatggaaaacgtggggaaaggcaaaaatagtgacagctgaaatacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccttcatagaggtgaaaacctgcacatggccaaaatcacacactctttggagcaatggtgtgctagagagtgacatgatcatcccaaagagtctagctggtcctatttcgcaacacaactacaggcccgggtatcacacccaaacggcaggaccctggcacttaggaaaattggagctggacttcaactattgtgaaggaacaacagttgtcatcacagaaaactgtgggacaagaggcccatcattgagaacaacaacagtgtcagggaagttgatacacgaatggtgttgccgctcgtgcacacttcctcccctgcgatacatgggagaagacggctgctggtatggcatggaaattagacccatcagtgagaaagaagagaacatggtaaagtctttagcctcagcagggagtggaaaggtggacaacttcacaatgggtgtcttgtgtttggcaatcctctttgaagaggtgatgagaggaaaatttgggaagaaacacatgattgcaggggttttcttcacgttcgtgctccttctctcggggcaaataacatggagagacatggcgcacacactcataatgatagggtccaacgcctctgacaggatgggaatgggcgtcacttacctagctttaattgcaacgtttaaaatccagccattcttggctttgggatttttcctaagaaaactgacatctagagaaaatttattgttaggagttgggttggctatggcaacaacgctgcaactgccagaggacattgaacaaatggcaaatggaatcgctctggggctcatggctcttaaactgataacacaatttgaaacataccaattatggacggcattagtctccttaacgtgctcaaatacaatgtttacgttgactgttgcctggagaacagccaccctgattttggccggagtttcgcttttaccagtgtgccagtcttcgagcatgaggaaaacagactggctcccaatgactgtggcagctatgggagttccacccctaccactttttatttttagcttgaaagacacactcaaaaggagaagctggccactgaatgagggggtgatggctgttgggcttgtgagcattctggccagttctctccttaggaatgatgtgcccatggctggaccattagtggccgggggcttgctgatagcgtgctacgtcataaccggcacgtcagcagacctcactgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcatacttggcaaaagcaaacccaaagatccggcgttctatgggacgtacccagccccccagagacacagaaagcagaactggaagaaggggtctataggatcaaacagcaaggaatcctcgggaaaacccaagtaggggttggagtacagaaagaaggagtcttccacaccatgtggcacgtcacaagaggggcagtgttgacacataatgggaaaagactggaaccaaactgggctagcgtgaaaaaagatctgatttcatacggaggaggatggagattgagtgcacaatggcaaaagggggaggaggtgcaggttatcgctgtagagcctgggaagaacccaaagaactttcaaaccatgccaggcacttttcagactacaacaggggaaataggagcaatcgcactggattttaagcctggaacttcaggatctcctatcataaacagagagggaaaggtagtgggactgtatggcaatggagtggttacaaagaatggtggctacgtcagcggaatagcgcaaacaaatgcagaaccagatggaccgacaccagagttggaagaagagatgttcagaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagttagggttccaaattacaacttgataataatggatgaggcccatttcacagacccagccagtatagcggctagagggtacatatcaactcgtgtaggaatgggagaggcagccgcaattttcatgacagcaacacctcctggaacagctgatgcctttcctcagagcaacgctccaattcaagatgaagaaagggacataccagaacgctcatggaactcaggcaatgaatggattaccgacttcgctgggaaaacggtgtggtttgtccctagcataaaagccggaaatgacatagcaaactgcttgcgaaaaaacgggaaaaaggtcattcaacttagtagaaagacctttgacacagaatatcagaagactaaactgaatgattgggacttcgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagatcatgctcactggacagaagcaaaaatgctgctggacaacatcaacacaccagaagggattataccagctctctttgaaccagaaagggagaagtcagccgccatagacggtgaataccgcctgaagggtgagtccaggaagactttcgtggaactcatgaggagaggtgaccttccagtttggttagcccataaagtagcttcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcctttagcactcaaggaattcaaggattttgcggctggcagaaagtcaatcgcccttgatcttgtgacagaaataggaagagtgccttcacacttagcccacagaacgagaaacgctctggacaatctggtgatgctgcatacgtcagaacatggcggtagggcctacaggcatgcggtggaggaactaccagaaacaatggaaacactcctactcttgggactcatgatcctgttgacaggtggagcaatgcttttcttgatatcaggtaaagggattggaaagacttcaataggactcatttgtgtaattgcttccagcggcatgttgtggatggccgatgtcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggactgttggaaactacaaagagagatttaggaatgtctaaagagccaggtgttgtttctccaaccagctatttggatgtggacttgcacccagcatcagcctggacattgtacgccgtggccactacagtaataacaccaatgttgagacataccatagagaattctacagcaaatgtgtccctagcagctatagccaaccaggcagtggtcctgatgggtttggacaaaggatggccaatatcaaaaatggacttaggcgtaccactactggcattgggttgctattcacaagtgaacccactgactctaacagcggcagtacttttgctaatcacacattatgctattataggtccaggattgcaagcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttattaatgagaacatcatgggccttgtgtgaagctctaaccctagctacaggaccaataacaacactctgggaaggatcacctgggaagttttggaacaccacgatagctgtttctatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatccggaatcactgaagtggatagaacagaagccaaagaagggctgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagttacagaagtgcgaggatacacaaaaggcggtccaggacacgaagaaccagtacctatgtctacatatggatggaacatagttaagttaatgagtggaaaggatgtgttttatcttccacctgaaaagtgtgataccctgttgtgtgacattggagaatcttcaccaagcccaacagtggaagaaagcagaactataagagttttgaagatggttgaaccatggctaaaaaacaaccagttttgcattaaagtattgaacccttacatgccaactgtgattgagcacctagaaagactacaaaggaaacatggaggaatgcttgtgagaaatccactttcacgaaactccacgcacgaaatgtactggatatccaatggtacaggtaacatcgtctcttcagtcaacatggtatctagattgctactgaacagattcacgatgacacacaggaggcccaccatagagagagatgtggatttaggagcaggaactcgacatgttaatgcggaaccagaaatacccaacatggatgtcattggggaaagaataaaaaggatcaaggaggaacataattcaacatggcactatgatgacgaaaacccctacaaaacgtgggcttaccatggatcctatgaagtcaaagccacaggctcagcctcctccatgataaatggagtcgtgaaactcctcactaaaccatgggatgtggtgcccatggtgacacagatggcaatgacagatacaaccccttttggccagcagagagtctttaaagagaaagtggacaccaggacacctaggcccatgccagggacaagaaaggttatggagatcacagcggagtggctctggagaaccctgggaaggaacaaaagacccaggttatgcacaagggaagagttcacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttacaacatgatgggcaagagagagaagaaacttggagagtttggcaaagcaaaaggcagtagagctatatggtacatgtggttgggagctaggtaccttgagttcgaagcccttggattcttaaatgaagaccactggttctcgcgtgaaaactcttacagtggagtagaaggagaaggactgcacaagctaggatacatattaagagacatttccaagatacccggaggagctatgtatgctgatgacacagctggttgggacacaaggataacagaagatgacctgcacaatgaggaaaagatcacacagcaaatggaccctgaacacaggcagttagcgaacgctatatttaagctcacataccaaaacaaagtggtcaaagttcaacgaccgactccaacgggcacggtaatggacatcatatctaggaaagaccaaagaggcagtggacaggtgggaacttatggtctgaatacattcaccaacatggaagcccagttagtcagacaaatggaaggagaagatgtgctgtcaaaggcagacctcgagaaccctcatctgctagagaagaaaattacacaatggttggaaaccaaaggagtggagaggttaaaaagaatggccattagcggggatgattgcgtagtgaaaccaatcgatgacaggttcgccaatgccctgcttgctctgaacgatatgggaaaggttaggaaagacatacctcagtggcagccatcaaagggatggcatgattggcaacaggttcccttctgctcccaccactttcatgaattgatcatgaaagatggaagaaagttggtggttccctgcagaccccaagatgaattaataggaagagcaagaatctctcaaggagcgggatggagccttagagaaactgcatgtctggggaaagcctatgcccaaatgtggagtctcatgtattttcacagaagagatctcagactagcatccaacgccatatgttcagcagtaccagtccattgggtccccacaagtagaacgacatggtctattcatgctcaccatcagtggatgactacagaagacatgcttactgtctggaacagggtgtggatagaggataatccatggatggaagacaaaactccagttacaacttgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcgatgaagagattcaggaaggaggaggagtcagagggagccatttggtaa

SEQ ID NO: 7350 - RNA, 9873 nt, synthetic construct
  misc_feature 1..9873: note = derived and/or modified CDS sequence (wt) from DENV-3__GQ252674__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaaaagatcagtggcgttagctcctcatgttggcatgggactggacacacgcacccaaacctggatgtcggctgaaggagcttggagacaagtcgagaaggtagagacatgggccctcaggcacccagggttcaccatactagccctatttcttgcccattacataggcacttccttgacccagaaggtggtcatttttatactactaatgctggtcaccccatccatgacaatgagatgtgtgggaataggaaacagagattttgtggaaggtctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaatggttgtggcttgtttggcaagggaagcttggtaacgtgtgcgaaatttcaatgcctggaaccaatagagggaaaagtggtgcaatatgagaacctcaaatacaccgtcatcattacagtgcacacaggagaccaacaccaggtaggaaatgaaacgcagggagtcacggctgagataacacctcaggcatcaaccactgaagccatcttgcctgaatatggaacccttgggctagaatgctcaccacggacaggtttggactttaatgaaatgatcttactaacaatgaagaacaaagcatggatggtacatagacaatggttttttgacctacctctaccatggacatcaggagctacaacagaaacgccaacctggaacaggaaggagcttcttgtgacgttcaaaaacgcacatgcgaaaaaacaagaagtagtcgtccttggatcgcaagagggagcaatgcataccgcactgacaggagccacagaaatccaaaactcaggaggcacaagcatttttgcggggcacttaaaatgtagacttaagatggacaaattggaactcaaggggatgagctatgcaatgtgcacaaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgatcacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgtttgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtgatgaaaattggaataggtgttctcttgacttggatagggttgaattcaaaaaacacatccatgtcattttcatgcattgcgataggaatcatcacactctatctgggagctgtggtacaagctgacatggggtgtgtcataaactggaaaggcaaagaactcaaatgtggaagtggaattttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcttgtggaagcaaatagccaatgaactgaactacatattatgggaaaataatatcaagttaacggtagttgtgggcgatacaattggggtcttagagcaaggaaaaagaacactaacaccacaacctatggagctaaaatactcatggaaaacatggggaaaggcaaaaatagtgacagctgaaacacaaaattcctccttcataatagacgggccaaacacaccggagtgtccaagtgcctcaagagcatggaatgtgtgggaggtggaagattacgggttcggagtcttcacaaccaacatatggctgaaactccgagatgtgtacacccaactatgtgaccataggctaatgtcggcggccgttaaggatgagagggccgtacacgccgacatgggctattggatagaaagtcaaaagaatggaagttggaagctagaaaaagcatccctcatagaggtgaaaacctgcacatggccaaaatcacacactctttggagcaatggtgtgctagagagtgacatgatcatcccaaagagtctagctggtcctatttcgcaacacaactacaggcctgggtaccacacccaaacagcaggaccctggcacttaggaaaattggagctggacttcaactattgtgaaggaacaacagttgtcatcacagaaaactgtgggacaagaggcccatcattgagaacaacaacagtgtcagggaagttgatacacgaatggtgttgccgctcgtgcacacttcctcccctgcgatacatgggagaagacggctgctggtatggcatggaaatcagacccatcagtgagaaagaagagaacatggtaaagtctttagtctcagcgggaagtggaaaggtagacaacttcacaatgggtgtcttgtgtttggcaatcctctttgaagaggtgatgagaggaaaatttgggaagaaacacatgattgcaggggttctcttcacgtttgtgctccttctctcagggcaaataacatggagagacatggcgcacacactaataatgattgggtccaacgcctctgacaggatgggaatgggcgtcacctacctagctttaattgcaacatttaaaatccagccattcttggctttgggatttttcctaagaaaactgacatctagagaaaatttattgttaggagttgggctggctatggcaacaacgttacaactgccagaggacattgaacaaatggcaaatggaatcgctctggggctcatggctcttaaactgataacacaatttgaaacataccaattatggacggcattagtctccttaacgtgttcaaatacaattcttacgttaactgttgcctggagaacagccaccctgattttggccggagtttcgcttttaccagtgtgccagtcttcgagcatgaggaaaacagactggcttccaatgacagtggcagctatgggagttccacccctaccactttttattttcagcctgaaagacacactcaaaaggagaagctggccactgaatgaaggggtgatggctgttgggcttgtgagcattctggccagttctctccttagaaatgatgtgcccatggctggaccattagtggccgggggcttgctgatagcgtgctacgtcataactggcacgtcagcagacctcactgtggaaaatgcggcagatgtgacatgggaggaagaggccgagcaaacaggagtgtcccacaacttaatgatcacagttgatgatgatggaacaatgagaataaaagatgatgagactgagaacatcctaacagtgcttttaaaaacggcattactaatagtatcaggcatctttccatactccatacctgcaacattgttggtctggcatacctggcaaaagcaaacccaaagatccggcgttctgtgggacgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatacggaggaggatggagattgagcgcgcaatggcaaaggggggaggaggtgcaggttattgccgtggagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtacggcaatggagtggttacaaagaatggtggctacgtcagcggaatagcgcaaacaaatgcagaaccagatggacctacaccagagttggaagaagagatgttcaaaaagcgaaatttaaccataatggatcttcatcctgggtcaggaaagacacgaaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcttgctgtcaccagttagggttccaaattataacttgataataatggatgaggcccatttcacagacccagccagtatagcggccagagggtacatatcaactcgtgttggaatgggagaggcagccgcaattttcatgacagcaacgccccctggaacagctgatgcctttccccagagcaacgctccaattcaagatgaagaaagggacataccagaacgctcatggaattcaggcaatgaatggattaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaataccagtcaccgcggcgagtgctgcgcaaaggagaggaagagttggtaggaacccacaaaaagaaaatgaccagtacatattcacgggccagcctctcaacaatgatgaagaccatgctcactggacagaagcaaaaatgctgctggacaacattaacacaccagaagggattataccagctctctttgagccagaaagggagaagtcagccgccatagacggtgagtaccgcctgaagggtgagtccaggaagactttcgtggaactcatgaggaggggagaccttccagtttggttagcccataaagtagcatcagaagggatcaaatatacagatagaaaatggtgctttgatggacaacgcaataatcaaattttagaggagaacatggatgtggaaatctggacaaaggaaggagaaaagaaaaaattgagacctaggtggcttgacgcccgcacttattcagatcccttagcactcaaggaatttaaggactttgcggctggcagaaagtcaatcgcccttgatcttgtgacagaaataggaagagtgccttcacacctagcccacagaacgagaaacgctctggacaatctggtaatgctgcatacttcagaacatggcggtagggcctacaggcatgcggtggaggaactaccagaaacaatggaaacactcttactcttgggactcatgattttgttgacaggtggagcaatgcttttcttgatatcaggaaaagggattggaaagacttcaataggactcatttgtgtaattgcctccagcggcatgttgtggatggccgaaatcccactccagtggatcgcgtcagctatagtcctggagttttttatgatggtgttgcttataccagaaccagaaaagcagagaaccccccaagacaaccaactcgcatatgttgtgataggcatacttacattggctgcaataatagcagccaatgaaatgggactgttggaaactacaaagagagatttaggaatgtctaaggagccaggtgttgtttctccaaccagctatttggatgtggacttgcacccagcatcagcctggacattgtacgccgtggccactacagtaataacaccaatgttaagacatactatagagaactctacagcaaatgtgtccctggcagctatagccaaccaggcagtggtcctgatgggtttggacaaaggatggccaatatcaaaaatggacttaggcgtaccactactggcattgggttgctattcacaagtgaacccactgactctaacagcggcagtacttttgctaatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagccacaggaccaataacaacactctgggaaggatcacctggaaagttttggaacaccacgatagctgtttccatggcgaacatttttagagggagctatttagcaggagctgggcttgctttttctattatgaaatcagttggaacaggaaaaagaggaacaggttcacaaggcgaaactttaggagaaaaatggaaaaagaaattaaaccaattatcccggaaagagtttgacctttacaagaaatctggaatcactgaagtggatagaacagaagccaaagaaggattgaagagaggagaaataacacatcatgccgtgtccagaggtagcgcaaaacttcaatggtttgtggagagaaacatggtcattcccgaaggaagagtcatagacttgggctgtggaagaggaggctggtcatactactgtgcaggactgaaaaaagtcacagaagtacgaggatacacaaaaggcggtccaggacacgaagaaccagtacccatgtctacatatggatggaacatagttaagttaatgagtggaaaggatgtgttttatcttccacctgaaaagtgtgataccctgttgtgtgacattggagaatcttcaccaagcccaacagtggaagaaagcagaaccataagagttttgaagatggttgaaccatggctaaaaaacaaccagttttgcattaaagtattgaacccttacatgccaactgtgattgaacacctagaaagattacaaaggaaacatggaggaatgcttgtgagaaatccactttcacgaaactccacgcacgaaatgtactggatatctaatggcacaggtaacattgtctcttcagtcaacatggtatctagattgctactgaacaggttcacgatgacacacaggagacctaccatagagaaagatgtggatttaggagcaggaactcgacatgttaatgcggaaccagaaacacccaacatggatgtcattggggaaagaataaaaaggattaaggaggagcacaattcaacatggcactatgatgacgaaaacccctacaaaacgtgggcttaccatggatcctatgaagtcaaagccacaggctcagcctcctccatgataaatggagtcgtgaaactcctcactaaaccatgggatgtggtgcctatggtgacacagatggcaatgacagatacaactccatttggccagcagagagtctttaaagagaaagtggacaccaggacacccaggtccatgccagggacaagaaaggttatggggatcacagcggaatggctctggagaaccctgggaaggaacaaaagacccaggttatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcctaaatgaagaccactggttctcgcgtgacaactcttacagtggagtagaaggagaaggactgcacaagctaggctacatattaagggacatttccaagatacccggaggagctatgtatgctgacgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacgggcacggtaatggacattatatctaggaaagaccaaagaggcagtggacaggtgggaacttatggtctgaatacattcaccaacatggaagtccagttagtcagacaaatggaaggagaaggtgtgctgtcaaaggcagacctcgagaaccctcatctgccagagaagaaaatcacacaatggttggaaaccaaaggagtggagaggttaaaaagaatggccattagcggggatgattgtgtagtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaggatggaagaaagttagtggttccctgtagaccccaggacgaactaataggaagagcaagaatctctcaaggagcgggatggagccttagagagaccgcatgtctggggaaagcctacgctcaaatgtggagtctcatgtactttcacagaagagatctcagactagcatccaacgccatatgttcagcagtaccagtccactgggtccccacaagtagaacgacatggtctattcatgctcaccatcagtggatgactacagaagacatgcttactgtctggaacagggtgtggatcgaggacaatccatggatggaaaacaaaactccagttacaacctgggaaaatgttccatatctagggaagagagaagaccaatggtgcggatcacttattggtctcacctccagagcaacctgggcccagaacatacccacagcaatccaacaggtgagaagccttataggcaatgaagagtttctggattacatgccttcaatgaagagattcaggaaggaggaggagtcggaaggagccatttggtaa

SEQ ID NO: 7351 - RNA, 9873 nt, synthetic construct
  misc_feature 1..9873: note = derived and/or modified CDS sequence (wt) from DENV-3__GQ199889__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatctctactttttaagacagcctctggaattaacatgtgcacactcatagccatggacttgggagaaatgtgtgatgacacggtcacttacaaatgcccccacattaccgaagtggaacctgaagacattgactgttggtgcaaccttacgtcgacatgggtgacttatggaacgtgcaatcaagctggagagcacagacgcgacaagagatcagtggcgttagctccccatgttggcatgggactggatacacgcacccaaacctggatgtcggctgaaggagcttggagacaagtcgagaaggtagagacatgggcccttaggcacccagggttcaccatactagccctatttcttgcccattacataggcacttccttgacccagaaagtggttatttttatactactaatactggtcactccatccatggcaatgagatgcgtgggagtaggaaacagagattttgtggaaggtctatcgggagctacgtgggttgacgtggtgctcgagcacggtgggtgtgtgactaccatggctaagaacaagcccacgctggatatagagcttcagaagaccgaggccacccaactggcgaccctaaggaagttatgcattgaggggaaaattaccaacataacaactgactcaagatgtcctacccaaggggaagcgatcttgcctgaggagcaggaccagaactacgtgtgtaagcatacatacgtagacagaggctgggggaacggttgtggtttgtttggcaagggaagcttggtaacatgtgcgaaatttcaatgcctggaatcaatagagggaaaagtggtgcaatatgagaacctcaaatacaccgtcatcattacagtgcacacaggagaccaacaccaggtgggaaatgaaacgcagggagtcacggctgaaataacacctcaggcatcaaccactgaagccatcttgcctgaatatggtacccttgggctagaatgctcaccacggacaggtttggatttcaatgaaatgatcttactaacaatgaagaacaaagcatggatggtacatagacaatggttctttgatctacctctaccatggacatcaggagctacaacagaaacaccaacctggaacaggaaggagcttcttgtgacattcaaaaacgcacatgcgaaaaaacaagaagtagttgtccttggatcgcaagagggagcaatgcatacagcactgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcattaaagtcgagtacaaaggggaagatgcaccttgcaagattcctttctccacagaggatggacaagggaaagctcacaatggcagactgatcacagccaacccagtggtgactaagaaggaggagcctgtcaatattgaggctgaacctccttttggggaaagtaatatagtaattggaattggagacaacgccttgaaaatcaactggtacaagaagggaagctcgattgggaagatgttcgaggccactgccagaggtgcaaggcgcatggccatcttgggagacacagcctgggactttggatcagtgggtggtgttctgaactcattgggcaaaatggtgcaccaaatatttggaagtgcttacacagccctattcagtggagtctcttgggtgatgaaaattggaataggtgtcctcttgacttggatagggttgaattcaaaaaacacatccatgtcattttcatgcattgcgataggaatcattacactctatctgggagccgtggtacaagctgacacagggtgtgtcataaactggaaaggcaaagaactcaaatgtggaagtggaattttcgtcaccaacgaggtccatacctggacagagcaatacaaattccaagcagactccccaaaaagattggcgacagccattgcaggcgcttgggagaatggagtatgcggaatcaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatattcatggaaaacgtggggaaaggcaaaaatagtgacagctgaaatacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctggaaaaagcatccttcatagaggtgaaaacctgcacatggccaaaatcacacactctttggagcaatggtgtgctagagagtgacatgatcatcccaaagagtctagctggtcctatttcgcaacacaactacaggcccgggtatcacacccaaacggcaggaccctggcacttaggaaaattggagctggacttcaactattgtgaaggaacaacagttgtcatcacagaaaactgtgggacaagaggcccatcattgagaacaacaacagtgtcagggaagttgatacacgaatggtgttgccgctcgtgcacacttcctcccctgcgatacatgggagaagacggctgctggtatggcatggaaattagacccatcagtgagaaagaagagaacatggtaaagtctttagcctcagcagggagtggaaaggtggacaacttcacaatgggtgtcttgtgtttggcaatcctctttgaagaggtgatgagaggaaaatttgggaaaaagcacatgattgcaggggttttcttcacgttcgtgctccttctctcggggcaaataacatggagagacatggcgcacacactcataatgatagggtccaacgcctctgacaggatgggaatgggcgtcacttacctagctttaattgcaacgtttaaaatccagccattcttggctttgggatttttcctaagaaaactgacatctagagaaaatttattgttaggagttgggttggctatggcaacaacgctgcaactgccagaggacattgaacaaatggcaaatggaatcgctctggggctcatggctcttaaactgataacacaatttgaaacataccaattatggacggcattaatctccctaacgtgctcaaatacaatgtttacgttgactgttgcctggagaacagccaccctgattttggccggagtttcgcttttaccagtgtgccagtcttcgagcatgaggaaaacagactggctcccaatgactgtggcagctatgggagttccacccctaccactttttatttttagcttgaaagacacactcaaaaggagaagctggccactgaatgagggggtgatggctgttgggctcgtgagcattctggccagttctctccttaggaatgatgtgcccatggctggaccattagtggccgggggcatgctgatagcgtgctacgtcataaccggcacgtcagcagacctcactgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcatacttggcaaaagcaaacccaaagatccggcgttctatgggacgtacctagccccccagagacacagaaagcagaactggaagaaggggtctataggatcaaacagcaaggaatcctcgggaaaacccaagtaggggttggagtacagaaagaaggagtcttccacaccatgtggcacgtcacaagaggggcagtgttgacacacaatgggaaaagactggaaccaaactgggctagcgtgaaaaaagatctgatttcatacggaggaggatggagattgagtgcacaatggcaaaagggggaggaggtgcaggttatcgctgtagagcctgggaagaacccaaagaactttcaaaccatgccaggcacttttcagactacaacaggggaaataggagcaattgcactggattttaagcctggaacttcaggatctcctatcataaacagagagggaaaggtagtgggactgtatggcaatggagtggttacaaagaatggtggctacgtcagcggaatagcgcaaacaagtgcagaaccagatggaccgacaccagagttggaagaagagatgttcagaaagcgaaatctaactataatggatcttcatcctgggtcaggaaagacacggaaataccttccagctatcgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagttagggttccaaattacaacttgataataatggatgaggcccatttcacagacccagccagtatagcggctagagggtacatatcaactcgtgtaggaatgggagaggcagccgcaattttcatgacagcaacacctcctggaacagctgatgcctttcctcagagcaatgctccaattcaagatgaagagagggacataccagaacgctcatggaactcaggcaatgaatggatcaccgacttcgctgggaaaacggtgtggtttgtccctagcataaaagccggaaatgacatagcgaactgcttgcgaaaaaacgggaaaaaggtcattcaacttagtagaaagacctttgacacagaatatcagaagactaaactgaatgattgggacttcgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgacgaagatcatgctcactggacagaagcaaaaatgctgctggacaacatcaacacaccagaagggattataccagctctctttgaaccagaaagggagaagtcagccgccatagacggtgaataccgcctgaagggtgagtccaggaagaccttcgtggaactcatgaggaggggtgacctcccagtttggctagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcctttagcactcaaggaattcaaggattttgcggctggcagaaagtcaatcgcccttgatcttgtgacagaaataggaagagtgccttcacacttagcccacagaacgagaaacgctctggacaatctggtgatgctgcatacgtcagaacatggcggtagggcttacaggcatgcggtggaggaactaccagaaacaatggaaacactcctactcttgggactcatgatcctgttgacaggtggagcaatgcttttcttgatatcaggtaaagggattggaaagacttcaataggactcatttgtgtaattgcttccagcggcatgttgtggatggccgatgtcccactccaatggatcgcgtcggctatagtcctggagttttttatgatggtgttgcttataccagaaccagaaaagcagagaaccccccaggacaaccaactcgcatatgtcgtgataggcatacttacattggctgcaataatagcagccaatgaaatgggactgttggaaactacaaagagagatctaggaatgtctaaagagccaggtgttgtttctccaactagctatttggatgtggacttgcacccagcatcagcctggacattgtacgccgtggccactacagtaataacaccaatgttgagacataccatagagaattctacagcaaatgtgtccctagcagctatagccaaccaggcagtggtcctgatgggtttggacaaaggatggccaatatcaaaaatggacttaggcgtaccactactggcattgggttgctattcacaagtgaacccactgactctaacagcggcagtacttttgctaatcacacactatgctattataggcccaggattgcaagcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttctattaatgagaacatcatgggccttgtgtgaagctctaaccctagctacaggaccaataacaacactctgggaaggatcacctgggaagttttggaacaccacgatagctgtttctatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatccggaatcactgaagtggatagaacagaagccaaagaagggctgaaaagaggagaaacaacacgtcatgccgtgtccagaggcagcgcaaaacttcaatggttcgtggagagaaacatggtcattcccgaaggaagagtcatagacttaggctgtggaagaggaggctggtcatattactgcgcaggactgaagaaagttacagaagtgcgaggatacacaaaaggcggtccaggacacgaagaaccagtacctatgtctacatacggatggaacatagtcaagttaatgagtggaaaggatgtgttttatcttccacctgaaaagtgtgacaccctattgtgtgacattggagaatcttcaccaagcccaacagtggaagaaagcagaactataagagttttgaagatggttgaaccatggctaaaaaacaaccagttttgcattaaagtattgaacccttacatgccaactgtgattgagcacctagaaagattacaaaggaaacatggaggaatgcttgtgagaaatccactttcacgaaactccacgcacgaaatgtactggatatccaatggcacaggtaacatcgtctcttcagtcaacatggtatctagattgctactgaacagattcacgatgacacacaggaggcccaccatagagagagatgtggatttaggagcaggaactcgacatgttaatgcggaaccagaaatacccaacatggatgtcattggggaaagaataaaaaggatcaaggaggaacataattcaacatggcactatgatgacgaaaacccctacaaaacgtgggcttaccatggatcctatgaagtcaaagccacaggctcagcctcctccatgataaatggagttgtgaaactcctcactaaaccatgggatgtggtgcccatggtgacacagatggcaatgacagatacaaccccttttggccagcagagagtctttaaagagaaagtggacaccaggacacctaggcccatgccagggacaagaaaggttatggagatcacagcggagtggctctggagaaccctaggaaggaacaaaagacccaggttatgcacaagggaagagttcacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggatacatattaagagacatttccaagatacccggaggagctatgtatgctgatgacacagctggttgggacacaaggataacagaagatgacctgcacaatgaggaaaagatcacacagcaaatggaccctgaacacaggcagttagcgaacgctatatttaagctcacataccaaaacaaagtggtcaaagttcaacgaccgactccaacgggcacggtaatggacatcatatctaggaaagaccaaagaggcagtggacaggtgggaacttatggtctgaacacatttaccaacatggaagcccagttagtcagacaaatggaaggagaaggtgtgctgtcaaaggcagacctcgagaaccctcatctgctagagaagaaaattacacaatggttggaaaccaaaggagtggagaggttaaaaagaatggccattagcggggatgattgcgtagtgaaaccaatcgatgataggttcgccaatgccctgcttgctctgaacgatatgggaaaggttaggaaagacatacctcagtggcagccatcaaaaggatggcatgattggcaacaggttcccttctgctcccaccactttcatgaattgatcatgaaagatggaagaaagttggtggttccctgcagaccccaagatgaattaataggaagagcaagaatctctcaaggagcgggatggagccttagagaaactgcatgtctggggaaagcctatgcccaaatgtggagtctcatgtattttcacagaagagatctcagactagcatccaacgctatatgttcagcagtaccagtccattgggtccccacaagtagaacgacatggtctattcatgctcaccatcagtggatgactacagaagacatgcttactgtctggaacagggtgtggatagaggataatccatggatggaagacaaaactccagttacaacttgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcgatgaagagattcaggaaggaggaggagtcagagggagccatttggtaa

SEQ ID NO: 7352 - RNA, 9873 nt, synthetic construct
  misc_feature 1..9873: note = derived and/or modified CDS sequence (wt) from DENV-3__FJ882571__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaaaagatcagtggcgttagctcctcatgtcggcatgggactggacacacgcacccaaacctggatgtcggctgaaggagcttggagacaagtcgagaaggtagagacatgggccctcaggcacccagggttcaccatactagctctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgattcaagatgtcctacccaaggggaagcggttttgcctgaggagcaggaccagaactacgtgtgtaagcatacatacgtagacagaggctgggggaacggttgtggcttgtttggcaagggaagcttggtaacgtgtgcgaaatttcaatgcctggaaccaatagagggaaaagtggtgcaatatgagaacctcaaatacaccgtcatcattacagtgcacacaggagaccaacaccaggtaggaaatgaaacgcagggagtcacggctgagataacacctcaggcatcaaccactgaagccatcttgcctgaatatggaacccttgggctagaatgctcaccacggacaggtttggatttcaatgaaatgatcttactaacaatgaagaacaaagcatggatggtacatagacaatggttttttgacctacctctaccatggacatcaggagctacaacagaaacgccaacctggaataggaaggagcttcttgtgacattcaaaaacgcacatgcgaaaaaacaagaagtagttgtccttggatcgcaagagggagcaatgcataccgcactgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgatcacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtgatgaaaattggaataggtgttctcttgacttggatagggttgaattcaaaaaacacatccatgtcattttcatgcattgcgataggaatcattacactctatctgggagctgtggtacaagctgacatggggtgtgtcataaactggaaaggcaaagaactcaaatgtggaagtggaattttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcttgtggaagcaaatagccaatgaactgaactacatattatgggaaaacaatatcaaattaacggtagttgtgggcgatacaattggggtcttagagcaaggaaaaagaactctaacaccacaacccatggagctaaaatactcatggaaaacgtggggaaaggcaaaaatagtgacagctgaaacacaaaattcctccttcataatagacgggccaaacacaccggagtgtccaagtgcctcaagagcatggaatgtgtgggaggtggaagattacgggttcggagtcttcacaaccaacatatggctgaaactccgagatgtgtacacccaactatgtgaccataggctaatgtcggcagccgtcaaggatgagagggccgtacacgccgacatgggctattggatagaaagccaaaagaatggaagttggaaactagaaaaagcatccctcatagaggtaaaaacctgcacatggccaaaatcacacactctttggagcaatggtgtgctagagagtgacatgatcatcccaaagagtctagctggtcctatttcgcaacacaactacaggcccgggtaccacacccaaacggcaggaccctggcacttaggaaaattggagctggacttcaactattgtgaaggaacaacagttgtcatcacagaaaactgtgggacaagaggcccatcattgagaacaacaacagtgtcagggaagttgatacacgaatggtgttgccgctcgtgcacacttcctcccctgcgatacatgggagaagacggctgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcaggggttctcttcacgtttgtgctccttctctcagggcaaataacatggagagacatggcgcacacactaataatgattgggtccaacgcctctgacaggatgggaatgggcgtcacctacctagctttaattgcaacatttaaaatccagccattcttggctttgggatttttcctaagaaaactgacatctagagaaaatttattgttaggagttgggctggctatggcaacaacgctacaactgccagaggacattgaacaaatggcaaatggaatcgctctggggctcatggctcttaaactgataacacaatttgaaacataccaactatggacggcattagtctccttaacgtgttcaaatacaattcttacgttgactgttgcctggagaacagccaccctgattttggccggagtttcgcttttaccagtgtgccagtcttcgagcatgaggaaaacagactggcttccaatgacagtggcagctatgggagttccacccctaccactttttatttttagcttgaaagacacactcaaaaggagaagctggccactgaatgaaggggtgatggctgttgggcttgtgagcatcctggccagttctctccttagaaatgatgtgcccatggctggaccattagtggccgggggcttgctgatagcgtgctacgtcataactggcacgtcagcagacctcattgtggaaaaagcagcagatgtaacatgggaggaagaggctgagcaaacaggagtgtcccacaacttaatgatcacagttgatgatgatggaacaatgagaataaaagatgatgagactgagaacatcctaacagtgcttttaaaaacagcattactaatagtatcaggcatctttccatactccatacccgcaacattgttggtctggcatacttggcaaaagcaaacccaaagatccggcgttctgtgggacgtacccagccccccagagacacagaaagcagaactggaagaaggggtttataggatcaaacagcaaggaattcttgggaaaacccaagtaggggttggagtacagaaagaaggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtggagcctgggaagaacccaaagaactttcaaaccatgccaggcacttttcaaactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacaaatgcagaaccagatggaccgacaccagagttggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcttgctgtcaccagttagggttccaaattataacttgataataatggatgaggcccatttcacagacccagccagtatagcggctagagggtacatatcaactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggacttcgtggtgacaactgacatttcagaaatgggggccaatttcaaagcagatagagtgatcgacccaagaagatgtctcaaaccagtgatcctgacagatggaccagaacgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggattataccagctctctttgaaccagaaagggagaagtcagccgccatagacggtgagtatcgcttgaagggtgagtccaggaagactttcgtggaactcatgaggaggggtgaccttccagtttggttagcccataaagtagcatcagaagggatcaaatatacagatagaaaatggtgctttgatggacaacgcaataatcaaattttagaggagaacatggatgtggaaatctggacaaaggaaggagaaaagaaaaaattgagacctaggtggcttgatgcccgcacttattcagatcccttagcactcaaggaatttaaggactttgcggctggcagaaagtcaatcgcccttgatcttgtgacagaaataggaagagtgccttcacacctagcccacagaacgagaaacgctctggacaatttggtgatgctgcacacgtcagaacatggcggtagggcctacaggcatgcggtggaggaactaccagaaacaatggaaacactcttactcttaggactcatgatcttgttgacaggtggagcaatgcttttcttgatatcaggaaaagggattggaaagacttcaataggactcatttgtgtaattgcctccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggactgttggaaactacaaagagagatttaggaatgtctaaggagccaggtgttgtttctccaaccagctatttggatgtggacttgcacccagcatcagcctggacattgtacgccgtggccactacagtaataacaccaatgttaagacataccatagagaattccacagcaaatgtgtccctggcggctatagccaaccaggcagtggtcctgatgggtttggacaaaggatggccaatatcaaaaatggacttaggcgtaccactactggcattgggttgctattcacaagtgaacccactgactctaacagcggcagtacttttgctaatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggttcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatactactgtgcaggactgaaaaaagtcacagaagtgcgaggatacacaaaaggcggtccaggacacgaagaaccagtacctatgtctacatatggttggaacatagttaagttaatgagtggaaaggatgtgttttatcttccacctgaaaagtgtgataccctgttgtgtgacattggagaatcttcaccaagcccaacagtggaagaaagcagaactataagagttttgaagatggttgaaccatggctaaaaaacaaccagttttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtatctagattgctactgaacaggttcacgatgacacacaggagacctaccatagagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcactaaaccatgggatgtggtgcccatggtgacacagatggcaatgacagatacaactccatttggccagcagagagtcttcaaagagaaagtggacaccaggacacccaggcccatgccagggacaagaaaggttatggggatcacagcggagtggctctggagaaccctgggaaggaacaaaagacccaggttatgcacaagggaagagtttacaaaaaaggtcagaactaacgcagccatgggcgccgttttcacagaggagaaccaatgggacagtgcgaaagctgctgttgaggatgaagaattttggaaacttgtggacagggaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcctaaatgaagaccactggttctcgcgtgacaactcttacagtggagtagaaggagaaggactgcacaagctaggctacatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacgggcacggtaatggacatcatatctaggaaagaccaaagaggcagcggacaggtgggaacttatggtctgaatacattcaccaacatggaagtccagttagtcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgccaatgccctgcttgctctgaacgacatgggaaaggttcggaaagacatacctcaatggcagccatcaaagggaatgcatgattggcaacaggttcctttctgctcccaccactttcatgaattgatcatgaaagatggaagaaagttagtggttccctgtagaccccaggacgaactaataggaagagcaagaatctctcaaggagcgggatggagccttagagaaaccgcatgtctggggaaagcttacgctcaaatgtggagtctcatgtattttcacagaagagatctcagactagcatccaacgccatatgttcagcagtaccagtccactgggtccccacaagtagaacgacatggtctattcatgctcaccatcagtggatgactacagaagacatgcttgctgtctggaacagggtgtggatcgaggacaatccatggatggaagacaaaactccagtcacaacttgggaagatgttccatatctagggaagagagaagaccaatggtgcggatcactcatcggtctcacttccagagcaacctgggcccagaacatactcacagcaattcaacaggtgagaagccttataggcaatgaagagtttctggattacatgccttcaatgaagagattcaggaaggaggaggagtcggaaggagccatttggtaa

SEQ ID NO: 7353 - RNA, 9873 nt, synthetic construct
  misc_feature 1..9873: note = derived and/or modified CDS sequence (wt) from DENV-3__FJ882572__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatctctactttttaagacagcctctggaattaacatgtgcacactcatagccatggacttgggagaaatgtgtgatgacacggtcacttacaaatgcccccacattaccgaagtggaacctgaagacattgactgttggtgcaaccttacgtcgacatgggtgacttatggaacgtgcaatcaagctggagagcacagacgcgacaagagatcagtggcgttagctccccatgttggcatgggactggatacacgcacccaaacctggatgtcggctgaaggagcttggagacaagtcgagaaggtagagacatgggcccttaggcacccagggttcaccatactagccctatttcttgcccattatataggcacttccttgacccagaaggtggtcattttcatactactaatgctggtcactccatccatgacaatgagatgtgtgggagtaggaaacagagattttgtggaaggtttatcaggagctacgtgggttgacgtggtgcttgagcacggtgggtgtgtgactaccatggctaagaacaagcccacgctggatatagagcttcagaagaccgaggccacccaactggcgaccctaaggaagttatgcattgaggggaaaattaccaacataacaactgactcaagatgtcctacccaaggggaagcggtcttgcctgaggagcaggaccagaactacgtgtgtaagcatacatacgtagacagaggctgggggaacggttgtggtttgtttggcaagggaagcttggtaacatgtgcgaaatttcaatgcctggaatcaatagagggaaaagtggtgcaatatgagaacctcaaatacaccgtcatcattacagtgcacacaggagaccaacaccaggtgggaaatgaaacgcagggagtcacggctgaaataacacctcaggcatcaaccactgaagccatcttgcctgaatatggtacccttgggctagaatgctcaccacggacaggtttggatttcaatgaaatgatcttactaacaatgaagaacaaagcatggatggtacatagacaatggttctttgatctacctctaccatggacatcaggagctacaacagaaacaccaacctggaacaggaaggagcttcttgtgacattcaaaaacgcacatgcgaaaaaacaagaagtagttgtccttggatcgcaagagggagcaatgcatacagcactgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcattaaagtcgagtacaaaggggaagatgcaccttgcaagattcctttctccacagaggatggacaagggaaagctcacaatggcagactgatcacagccaacccagtggtgactaagaaggaggagcctgtcaatattgaggctgaacctccttttggggaaagtaatatagtaattggaattggagacaacgccttgaaaatcaactggtacaagaagggaagctcgattgggaagatgttcgaggccactgccagaggtgcaaggcgcatggccatcttgggagacacagcctgggactttggatcagtgggtggtgttctgaactcattgggcaaaatggtgcaccaaatatttggaagtgcttacacagccctattcagtggagtctcttgggtgatgaaaattggaataggtgtcctcttgacttggatagggttgaattcaaaaaacacatccatgtcattttcatgcattgcgataggaatcattacactctatctgggagccgtggtacaagctgacacagggtgtgtcataaactggaaaggcaaagaactcaaatgtggaagtggaattttcgtcaccaacgaggtccatacctggacagagcaatacaaattccaagcagactccccaaaaagattggcgacagccattgcaggcgcttgggagaatggagtatgcggaatcaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatattcatggaaaacgtggggaaaggcaaaaatagtgacagctgaaatacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctggaaaaagcatccttcatagaggtgaaaacctgcacatggccaaaatcacacactctttggagcaatggtgtgctagagagtgacatgatcatcccaaagagtctagctggtcctatttcgcaacacaactacaggcccgggtatcacacccaaacggcaggaccctggcacttaggaaaattggagctggacttcaactattgtgaaggaacaacagttgtcatcacagaaaactgtgggacaagaggcccatcattgagaacaacaacagtgtcagggaagttgatacacgaatggtgttgccgctcgtgcacacttcctcccctgcgatacatgggagaagacggctgctggtatggcatggaaattagacccatcagtgagaaagaagagaacatggtaaagtctttagcctcagcagggagtggaaaggtggacaacttcacaatgggtgtcttgtgtttggcaatcctctttgaagaggtgatgagaggaaaatttgggaaaaagcacatgattgcaggggttttcttcacgttcgtgctccttctctcggggcaaataacatggagagacatggcgcacacactcataatgatagggtccaacgcctctgacaggatgggaatgggcgtcacttacctagctttaattgcaacgtttaaaatccagccattcttggctttgggatttttcctaagaaaactgacatctagagaaaatttattgttaggagttgggttggctatggcaacaacgctgcaactgccagaggacattgaacaaatggcaaatggaatcgctctggggctcatggctcttaaactgataacacaatttgaaacataccaattatggacggcattaatctccctaacgtgctcaaatacaatgtttacgttgactgttgcctggagaacagccaccctgattttggccggagtttcgcttttaccagtgtgccagtcttcgagcatgaggaaaacagactggctcccaatgactgtggcagctatgggagttccacccctaccactttttatttttagcttgaaagacacactcaaaaggagaagctggccactgaatgagggggtgatggctgttgggctcgtgagcattctggccagttctctccttaggaatgatgtgcccatggctggaccattagtggccgggggcatgctgatagcgtgctacgtcataaccggcacgtcagcagacctcactgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcatacttggcaaaagcaaacccaaagatccggcgttctatgggacgtacctagccccccagagacacagaaagcagaactggaagaaggggtctataggatcaaacagcaaggaatcctcgggaaaacccaagtaggggttggagtacagaaagaaggagtcttccacaccatgtggcacgtcacaagaggggcagtgttgacacacaatgggaaaagactggaaccaaactgggctagcgtgaaaaaagatctgatttcatacggaggaggatggagattgagtgcacaatggcaaaagggggaggaggtgcaggttatcgctgtagagcctgggaagaacccaaagaactttcaaaccatgccaggcacttttcagactacaacaggggaaataggagcaattgcactggattttaagcctggaacttcaggatctcctatcataaacagagagggaaaggtagtgggactgtatggcaatggagtggttacaaagaatggtggctacgtcagcggaatagcgcaaacaagtgcagaaccagatggaccgacaccagagttggaagaagagatgttcagaaagcgaaatctaactataatggatcttcatcctgggtcaggaaagacacggaaataccttccagctatcgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagttagggttccaaattacaacttgataataatggatgaggcccatttcacagacccagccagtatagcggctagagggtacatatcaactcgtgtaggaatgggagaggcagccgcaattttcatgacagcaacacctcctggaacagctgatgcctttcctcagagcaatgctccaattcaagatgaagagagggacataccagaacgctcatggaactcaggcaatgaatggatcaccgacttcgctgggaaaacggtgtggtttgtccctagcataaaagccggaaatgacatagcgaactgcttgcgaaaaaacgggaaaaaggtcattcaacttagtagaaagacctttgacacagaatatcagaagactaaactgaatgattgggacttcgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagcgctgcgcaaaggagagggagagttggcaggaacccacaaaaagaaaatgaccagtacatatttacgggccagcctctcaacaatgatgaagatcatgctcactggacagaagcaaaaatgctgctggacaacatcaacacaccagaagggattataccagctctctttgaaccagaaagggagaagtcagccgccatagacggtgaataccgcctgaagggtgagtccaggaagactttcgtggaactcatgaggaggggtgaccttccagtttggttagcccataaagtagcttcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcctttagcactcaaggaattcaaggattttgcggctggcagaaagtcaatcgcccttgatcttgtgacagaaataggaagagtgccttcacacttagcccacagaacgagaaacgctctggacaatctggtgatgctgcatacgtcagaacatggcggtagggcttacaggcatgcggtggaggaactaccagaaacaatggaaacactcctactcttgggactcatgatcctgttgacaggtggagcaatgcttttcttgatatcaggtaaagggattggaaagacttcaataggactcatttgtgtaattgcttccagcggcatgttgtggatggccgatgtcccactccaatggatcgcgtcggctatagtcctggagttttttatgatggtgttgcttataccagaaccagaaaagcagagaaccccccaggacaaccaactcgcatatgtcgtgataggcatacttacattggctgcaataatagcagccaatgaaatgggactgttggaaactacaaagagagatctaggaatgtctaaagagccaggtgttgtttctccaactagctatttggatgtggacttgcacccagcatcagcctggacattgtacgccgtggccactacagtaataacaccaatgttgagacataccatagagaattctacagcaaatgtgtccctagcagctatagccaaccaggcagtggtcctgatgggtttggacaaaggatggccaatatcaaaaatggacttaggcgtaccactactggcattgggttgctattcacaagtgaacccactgactctaacagcggcagtacttttgctaatcacacactatgctattataggcccaggattgcaagcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttctattaatgagaacatcatgggccttgtgtgaagctctaaccctagctacaggaccaataacaacactctgggaaggatcacctgggaagttttggaacaccacgatagctgtttctatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatccggaatcactgaagtggatagaacagaagccaaagaagggctgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaagaaagttacagaagtgcgaggatacacaaaaggcggtccaggacacgaagaaccagtacctatgtctacatatggatggaacatagttaagttaatgagtggaaaggatgtgttttatcttccacctgaaaagtgtgataccctgttgtgtgacattggagaatcttcaccaagcccaacagtggaagaaagcagaactataagagttttgaagatggttgaaccatggctaaaaaacaaccagttttgcattaaagtattgaacccttacatgccaactgtgattgagcacctagaaagattacaaaggaaacatggaggaatgcttgtgagaaatccactttcacgaaactccacgcacgaaatgtactggatatccaatggcacaggtaacatcgtctcttcagtcaacatggtatctagattgctactgaacagattcacgatgacacacaggaggcccaccatagagagagatgtggatttaggagcaggaactcgacatgttaatgcggaaccagaaatacccaacatggatgtcattggggaaagaataaaaaggatcaaggaggaacataattcaacatggcactatgatgacgaaaacccctacaaaacgtgggcttaccatggatcctatgaagtcaaagccacaggctcagcctcctccatgataaatggagttgtgaaactcctcactaaaccatgggatgtggtgcccatggtgacacagatggcaatgacagatacaaccccttttggccagcagagagtctttaaagagaaagtggacaccaggacacctaggcccatgccagggacaagaaaggttatggagatcacagcggagtggctctggagaaccctaggaaggaacaaaagacccaggttatgcacaagggaagagttcacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggatacatattaagagacatttccaagatacccggaggagctatgtatgctgatgacacagctggttgggacacaaggataacagaagatgacctgcacaatgaggaaaagatcacacagcaaatggaccctgaacacaggcagctagcgaacgctatatttaagctcacataccaaaacaaagtggtcaaagttcaacgaccgactccaacgggcacggtaatggacatcatatctaggaaagaccaaagaggcagtggacaggtgggaacttatggtctgaacacatttaccaacatggaagcccagttagtcagacaaatggaaggagaaggtgtgctgtcaaaggcagacctcgagaaccctcatctgctagagaagaaaattacacaatggttggaaaccaaaggagtggagaggttaaaaagaatggccattagcggggatgattgcgtagtgaaaccaatcgatgataggttcgccaatgccctgcttgctctgaacgatatgggaaaggttaggaaagacatacctcagtggcagccatcaaaaggatggcatgattggcaacaggttcccttctgctcccaccactttcatgaattgatcatgaaagatggaagaaagttggtggttccctgcagaccccaagatgaattaataggaagagcaagaatctctcaaggagcgggatggagccttagagaaactgcatgtctggggaaagcctatgcccaaatgtggagtctcatgtattttcacagaagagatctcagactagcatccaacgctatatgttcagcagtaccagtccattgggtccccacaagtagaacgacatggtctattcatgctcaccatcagtggatgactacagaagacatgcttactgtctggaacagggtgtggatagaggataatccatggatggaagacaaaactccagttacaacttgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcgatgaagagattcaggaaggaggaggagtcagagggagccatttggtaa

SEQ ID NO: 7354 - RNA, 9873 nt, synthetic construct
  misc_feature 1..9873: note = derived and/or modified CDS sequence (wt) from DENV-3__FJ882573__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggatttgggagagatgtgtgatgacacggtcacttacaaatgcccccacattaccgaagtggaacctgaagacattgactgctggtgcaacctcacatcaacatgggtgacttatggaacgtgcaatcaagctggagagcatagacgcgacaagagatcagtggcgctagctccccatgtcggcatgggactggacacacgaacccaaacctggatgtcggctgaaggagcttggagacaagtcgagaaggtagagacatgggcccttaggcacccagggttcaccatactagccctatttctcgcccattacataggcacttccttgacccagaaggtggttatttttatattattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggatttcaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagacgcaccttgcaagattcctttctccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgttcgaggccactgccagaggtgcaaggcgcatggccatcttgggagacacagcttgggactttggatcagtgggtggtgttctgaactcattaggcaaaatggtgcaccaaatatttggaagtgcttacacagctctgttcagtggagtctcttgggtgatgaaaattggaataggtgttctcttgacttggatagggttgaattcaaaaaacacacccatgtcattttcatgcattgcgataggaatcattacactctatctgggagctgtggtacaagctgacatggggtgtgtcataaactggaaaggcaaagaactcaaatgtggaagtggaattttcgtcaccaatgaggtccatacctggacagagcaatacaaattccaagcagactccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaactggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcttcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctattggatagaaagccaaaagaatggaagttggaagctagaaaaagcatccctcatagaggtgaagacctgcacatggccaaaatcacacactctctggagtaatggtgtgctagagagtgacatgatcatcccaaagagtctagctggtcctatttcacaacacaactacaggcccgggtaccacacccaaacggcaggaccctggcatttaggaaaattggagctggacttcaactattgtgaaggaacaacagttgtcatcacagaaaactgtgggacaagaggcccatcactgagaacaacaacagtgtcagggaagttgatacacgaatggtgttgccgctcgtgcacacttcctcccctgcgatacatgggagaagacggctgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgattgggtccaacgcctctgacaggatgggaatgggcgtcacctacctagctctaattgcaacatttaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattagtctccttaacgtgttcaaatacaatttttacgttgactgttgcttggagaacagccaccctgattttggccggagtttcgcttttaccagtgtgccagtcttcaagcatgaggaaaacagactggctcccaatgacagtggcagctatgggagttccaccccttccacttttcatttttagcttgaaagacacactcaaaaggagaagctggccactgaatgaaggggtgatggctgttgggcttgtgagcattctggccagctctctccttagaaatgatgtgcccatggctggaccattagtggccgggggcttgctgatagcgtgctacgtcataactggcacgtcagcagacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgctcttaaaaacagcattactaatagtatcaggcatttttccatactccatacccgcaacattgttggtctggcacacttggcaaaagcaaacccaaagatccggcgttttatgggacgtacccagccccccagagacacagaaagcagaactggaagaaggggtttataggatcaaacagcaaggaattcttgggaaaacccaagtaggggttggagtacagaaagaaggagtcttccacaccatgtggcacgtcacaagaggggcagtgttgacacataatgggaaaagactggaaccaaactgggctagcgtgaaaaaagatttgatttcatacggaggaggatggagactgagcgcacaatggcaaaagggggaggaggtgcaggtcattgccgtagagccagggaagaacccaaagaactttcaaaccatgccaggcacttttcagactacaacaggggaaataggagcaattgctctggatttcaagcctggaacttcaggatctcctatcataaacagagagggaaaggtagtgggactgtatggcaatggagtggttacaaagaatggtggctatgtcagcggaatagcgcaaacaaatgcagagccagatggaccgacaccagagttggaagaagagatgttcaaaaagcgaaatctaaccataatggatctccatcctgggtcaggaaagacacggaaataccttccagctatcgtcagagaggcaatcaagagacgtttaagaactttaattttggcaccgacaagggtggttgcagctgagatggaagaagcattgaaagggctcccaataaggtaccaaacaacagcaacaaaatccgaacacacaggaagagagattgttgatctaatgtgccacgcaacgttcacaatgcgcctgctgtcaccagttagggttccaaattacaacttgataataatggatgaggcccatttcacagacccagccagtatagcggctagagggtacatatcaactcgtgttggaatgggagaggcagccgcaattttcatgacagcaacaccccctggaacagctgatgcctttcctcagagcaacgctccaattcaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaaaactaaactgaatgattgggacttcgtggtgacaactgatatttcagaaatgggggccaatttcaaagcagatagagtgatcgacccaagaagatgtctcaaaccagtgatcttgacagatggaccagagcgggtgatcctggccggaccaatgccagtcaccgcggcgagtgctgcgcaaaggagagggagagttggcaggaacccacaaaaagaaaatgaccagtacatatttacgggccagcctctcaacaatgatgaagaccatgctcactggacagaagcaaaaatgctgctggacaacatcaacacaccagaagggattataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaagggatcaaatatacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacacctagcccacagaacgagaaacgctctggacaatctggtgatgctacatacgtcagaacatggcggtagggcttacaggcatgcggtggaggaactaccagaaacaatggaaacactcctactcttgggactcatgatcttgttgacaggtggagcaatgcttttcttgatatcaggtaaagggattggaaagacttcaataggactcatttgtgtaattgcttccagcggcatgctgtggatggccgaagtcccactccaatggatcgcgtcggctatagtcctggagttttttatgatggtgttgcttataccagaaccagaaaagcagagaaccccccaagacaaccaactcgcatatgtcgtgataggcatacttacattggctgcaatgatagcagccaatgaaatgggactgttggaaactacaaagagagacttaggaatgtctaaggagccaggtgttgtttctccaaccagctatttggatgtggacttgcacccagcatcagcctggacattgtacgccgtggccactacagtaataacaccaatgttaagacacaccatagagaattctacagcaaatgtgtccctggcagctatagccaaccaggcagtggtcctgatgggtttggacaaaggatggccaatatcaaaaatggacttaggcgtgccactattggcactgggttgctattcacaagtgaacccactgactctaactgcggcagtacttttgctaatcacacattatgctatcataggtccaggactgcaagcaaaagccacccgtgaagctcagaaaaggacagctgctggaataatgaagaatccaacggtggatgggataatgacaatagacctagatcctgtaatatatgattcaaaatttgagaaacaactgggacaggttatgctcctggttttgtgtgcagttcaacttttgttaatgagaacatcatgggccttgtgtgaagctttgaccctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagagataacacatcatgccgtgtccagaggtagcgcaaaacttcaatggtttgtggagagaaacatggtcgttcccgaaggaagagtcatagacttgggctgtggaagaggaggctggtcatattactgtgcaggactaaaaaaagtcacagaagtgcgaggatacacaaaaggcggtccaggacacgaagaaccagtacctatgtctacatatggatggaacatagttaagttaatgagtggaaaggatgtgttctatcttccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaatatggtgtctagattgctattgaacaggttcacgatgacacacaggagacccaccatagagaaagatgtggatttaggagcaggaactcgacatgttaatgcggaaccagaaacacccaacatggatgtcattggggaaagagtaaaaaggatcaaggaggagcataattcaacatggcactatgatgacgaaaacccctacaaaacgtgggcttaccatggatcctatgaagtcaaagccacaggctcagcctcctccatgataaatggagtcgtgaaacttctcactaaaccatgggatgtggtgcccatggtgacacagatggcaatgacagacacaactccatttggccagcagagagtctttaaagagaaagtggacaccaggacacccaggcccatgccagggacaagaaaggttatggagatcacagcggagtggctctggagaaccctgggaaggaacaaaagacccaggttatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaagaaactcggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacaggcagttagcgaacgccatatttaagctcacataccaaaacaaagtggtcaaagttcaacgaccgactccaacgggcacggtaatggacattatatctagaaaagaccaaagaggcagtggacaagtgggaacttatggcctgaatacattcaccaacatggaagcccagttagtcagacaaatggaaggagaaggtgtgctgacaaaggcagacctcgagaaccctcatctgctagagaagaaaattacacaatggttggaagccaaaggagtggagaggttaaaaagaatggccattagcggggatgattgtgtggtgaaaccaatcgatgacaggttcgctaatgccctgcttgctctgaacgatatgggaaaggtccggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtcttatgtattttcacagaagagatctcagactagcatccaacgccatatgttcagcagtaccagtccactgggttcccacaagcagaacgacatggtctattcatgctcaccatcagtggatgactacagaagacatgcttactgtttggaacagggtgtggatagaggaaaatccatggatggaagacaaaactccagttacaacttgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagtcggagggagccatttggtaa

SEQ ID NO: 7355 - RNA, 9873 nt, synthetic construct
  misc_feature 1..9873: note = derived and/or modified CDS sequence (wt) from DENV-3__FJ898440__SS-prME
  source 1..9873: mol_type = other RNA
acatcgctctgtctcatgatgatattgccagctgcacttgctttccacttgacttcacgagatggagagccgcgcatgattgtggggaagaatgaaagagggaaatccctactttttaagacagcctctggaattaacatgtgcacactcatagccatggacttgggagagatgtgtgatgacacggtcacttacaaatgcccccacattaccgaagtggaacctgaagatattgactgctggtgcaaccttacgtcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagactttgtggaaggtctatcaggagctacgtgggttgacgtggtgctcgagcacggggggtgtgtgactaccatggctaagaacaagcccacgttggatatagagcttcaaaagaccgaggccacccaactggcgaccctaaggaagctatgcattgaggggaaaattaccaacataacaactgactcaagatgtcccacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaatcactgaagccatcttgcctgaatatggaacccttgggctagaatgctcaccacggacaggtttggatttcaatgaaatggtcttgctaacaatgaagaacaaagcatggatggtacatagacaatggttttttgacctacctctaccatggacatcaggagctacaacggaaacaccaatctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgacaaaaaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctgttcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggtaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcctagagcaaggaaaaagaacactaacaccacaacccatggagctaaaatactcatggaaaacgtggggaaaggcaaaaatagtaacagctgaaacacaaaattcctctttcataatagacgggccaaacacaccagagtgtccaagtgcctcaagagcatggaatgtgtgggaggtggaagattacgggttcggagttttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcccatttcgcaacacaactacaggcccgggtaccacacccagacggcgggaccctggcatttaggaaaattagagctggatttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcggggagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacttacctagctttaattgcaacatttaaaatccagccattcttggctttgggatttttcctaagaaaactgacatctagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagcatgaggaaaacagactggcttccaatgacagtggcagctatgggagttcaacctctaccactttttatttttagcttgaaagacacactcaaaaggagaagttggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggccgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggacgtacccagccctccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctgggacttcaggatctcctatcataaacagagagggaaaggtagtgggactgtatggcaatggagtggtcacaaagaatggtggctacgtcagcggaatagcgcaaacgaatgcagaaccagatggaccgacaccagaattggaagaagagatgttcaaaaagcgaaatctaaccattatggatcttcatcctgggtcaggaaagacacggaaataccttccagctattgttagagaggcaatcaagagacgtttaagaaccctaattttggcaccgacaagggtggttgcagctgagatggaagaagcattgaaagggctcccaataaggtaccaaacaacagcaacaaaatctgaacacacaggaagagagattgttgatctaatgtgtcacgcaacgttcacaatgcgtctgctgtcaccagttagggttccaaactataacttgataataatggatgaagcccatttcacagacccagccagtatagcggctagagggtacatatcaactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcaaaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgccgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaaggaatcaaatacacagatagaaaatggtgctttgatggacaacgaaataatcaaattttagaggagaacatggatgtggaaatttggacaaaggaaggagaaaagaaaaaattgagacctaggtggcttgatgcccgcacttattcagatcccttagcactcaaggaatttaaggactttgcggctggcagaaaatcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggattgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagaaagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaagttaaatcaattatcccggaaagagtttgacctttacaagaaatctggaatcaccgaggtggatagaacggaagccaaagaagggttaaaaagaggagaaataacacatcatgccgtgtccagaggtagcgcaaaactccaatggttcgtggagagaaacatggtcattcccgaaggaagagttatagacttgggctgtggaagaggaggttggtcatattactgtgcaggactgaaaaaagtcacagaagtgcgaggatacacgaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagattacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctctatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggctatgcacaagggaagagtttacaaaaaaggtcagaactaacgcagccatgggcgccgttttcacagaggagaaccaatgggacagcgcgaaagctgctgttgaggatgaggatttttggaaacttgtggacagagaacgtgaactccacaagttgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatgaaccctgaacacaggcagttagcgaacgctatatttaagctcacataccaaaacaaagtggtcaaagttcaacgaccgactccaacaggcacagtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccggagaagaaaattacacaatggttggaaaccaaaggagtggagaggttaaaaagaatggccattagcggggatgattgcgtagtgaaaccaattgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagaagacatgcttactgtctggaacagggtgtggatcgaggacaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagaggtttaggaaggaggaggagtcggagggagccatttggtaa

SEQ ID NO: 7356 - RNA, 9873 nt, synthetic construct
  misc_feature 1..9873: note = derived and/or modified CDS sequence (wt) from DENV-3__FJ898441__SS-prME
  source 1..9873: mol_type = other RNA
acatcgctctgtctcatgatgatattgccagcagcacttgctttccacttgacttcacgagatggagagccgcgcatgatcgtggggaagaatgaaagagggaaatccctactttttaagacagcctctggaattaacatgtgcacactcatagccatggacttaggagagatgtgtgatgacacggtcacttacaaatgcccccacattaccgaagtggaacccgaagatattgactgctggtgcaaccttacgtcaacatgggtgacttatggaacgtgcaatcaagctggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccactacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagcccacattggatatagagcttcaaaagaccgaggccacccaactggcgaccctgaggaagctatgcattgaggggaaaattaccaacataacaactgactcaagatgccccacccaaggggaagcggttttgcctgaggagcaggaccagaactacgtgtgtaagcatacatacgtggacagaggctgggggaacggatgtggtttgtttggcaagggaagcttggtaacatgtgcgaaatttcaatgcctggaaccaatagagggaaaaatggtgcaatatgagaacctcaaatacaccgtcatcatcacagtgcacacaggagaccaacaccaggtgggaaatgaaacgcagggagtcacggctgagataacacctcaggcatcaatcactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaaccatttttgcggggcacttaaaatgtagacttaaaatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgacaaaaaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaagtatttggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggtaaagaacttaaatgtggaagtggaatcttcgtcaccaacgaggtccatacctggacagagcaatacaaattccaagcagactccccaaaaagactggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacctatggagttaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagccgtcaaggatgagagggccgtacacgccgacatgggctattggatagaaagccaaaagaatggaagttggaaactagaaaaagcatccctcatagaggtgaaaacctgcacatggccaaaatcacataccctttggagtaatggtgtgctagagagtgacatgatcatcccaaagagcctagctggtcccatttcgcaacacaactacaggcccgggtaccacacccagacggcgggaccctggcatttaggaaaattagagctggatttcaactattgtgaaggaacaacagttgtcatcacagaaaactgtgggacaagaggcccatcattgagaacaacaacagtgtcagggaagttaatacacgaatggtgttgccgctcgtgcacactccctcccctgcgatacatgggagaagacggttgttggtatggcatggaaatcagacccatcagtgagaaagaagagaacatggtaaagtctttggtctcagcggggagtggaaaggtggataacttcacaatgggtgtcttgtgtttggcaatcctctttgaagaggtgatgagaggaaaatttgggaagaaacacatgattgtgggggttttcttcacgtttgtgctccttctctcagggcaaataacatggagagacatggcgcacacactaataatgattgggtccaacgcatctgacaggatgggaatgggcgttacctacctagccttaattgcaacatttaaaatccagccattcttggctttgggatttttcctaagaaaactgacatccagagaaaatttattgttaggagttgggctggctatggcaacaacgttacaactgccagcggacattgaacaaatggcaaatggaatcgctctggggcttatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagtatgaggaaaacagactggcttccaatgacagtggcagctatgggagttcaacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggccgagcaaacaggagtgtcccacaacttaatgatcacagttgatgacgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcgcaatggcaaaagggggaggaggtgcaggtcattgccgtagagcctgggaagaacccaaagaactttcaaaccatgccaggcacttttcagactacaacaggggaaataggagcaattgcactggatttcaagcctgggacttcaggatctcctatcataaacagagagggaaaggtagtgggactgtatggcaatggagtggtcacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcaactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcataaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtctaggaagactttcgtggaactcatgaggaggggcgaccttccagtctggttagcccataaagtagcatcagaagggatcaaatatacagatagaaaatggtgctttgatggacaacgaaataatcaaatcttagaggagaacatggatgtggaaatttggacaaaagaaggagaaaagaaaaaattgagacctaggtggcttgatgcccgcacttattcagatcccttagcactcaaggaatttaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggattgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagaaagatttaggaatgtctaaggagccaggtgttgtttcttcaaccagctatttagatgtggacttgcacccagcatcagcctggacattgtacgccgtggccactacagtaataacaccaatgttaagacataccatagagaattctacagcaaatgtgtccctggcagccatagccaaccaggcagtggtcctgatgggtttggacaaaggatggccaatatcaaaaatggacttaggagtacccctactggcattgggttgctactcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgccttttctattatgaaatcagttggaacaggaaaaagaggaacaggctcacaaggtgaaactttaggagaaaaatggaaaaagaagttaaatcaattatcccggaaagagtttgacctttacaagaaatctggaattaccgaggtggatagaacggaagccaaagaagggttaaaaagaggagaaataacacatcatgccgtgtccagaggtagcgcaaaactccaatggttcgtggagagaaacatggtcattcccgaaggaagagtcatagacttgggctgtggaagaggaggttggtcatattactgtgcaggactgaaaaaagtcacagaagtgcgaggatacacaaaaggcggtccaggacacgaagaaccagtacctatgtccacatatggatggaacatagttaagttaatgactggaaaggatgtgttttatcttccacctgaaaagtgtgataccctgctgtgtgacattggagaatcttcaccaagcccaacagtggaagaaagcagaactataagagttttgaagatggttgaaccatggctaaagaacaaccaattttgtatcaaagtattgaacccgtacatgccaactgtgattgagcacctagaaagattacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagagagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaaaggttatggggatcacagcggagtggctctggagaaccctgggaaggaacaaaaaacccaggctatgcacaagggaggagtttacaaaaaaggttagaactaacgcagccatgggcgccgttttcacagaggagaaccaatgggacagcgcgaaagctgctgttgaggatgaggatttttggaaacttgtggacagagaacgtgaactccacaagttgggcaagtgtggaagctgtgtttacaacatgatgggcaagagagagaagaaacttggagagtttggcaaagcgaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccacgatacccggaggagcaatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggaacagtaatggacatcatatctaggaaagaccaaagaggcagtgggcaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaattgatgataggttcgctaatgccctgctcgctctgaacgatatgggaaaggttcggaaagatatacctcaatggcagccatcaaagggatggcatgattggcaacaggttcctttctgctcccaccactttcatgaattgatcatgaaagatggaagaaagttggtggttccctgcagaccccaggacgaattaataggaagagcaagaatctctcaaggagcgggatggagccttagagaaaccgcatgtttggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagaagacatgcttactgtctggaacagggtgtggatcgaggacaatccatggatggaagacaaaactccagttacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagaggtttaggaaggaggaggagtcggagggagccatttggtaa

SEQ ID NO: 7357 - RNA, 9873 nt, synthetic construct
  misc_feature 1..9873: note = derived and/or modified CDS sequence (wt) from DENV-3__FJ898442__SS-prME
  source 1..9873: mol_type = other RNA
acatcgctctgtctcatgatgatattgccagcagcacttgctttccacttgacttcacgagatggagagccgcgcatgatcgtggggaagaatgaaagagggaaatccctactttttaagacagcctctggaattaacatgtgcacactcatagccatggacttaggagagatgtgtgatgacacggtcacttacaaatgcccccacattaccgaagtggaacccgaagatattgactgctggtgcaaccttacgtcaacatgggtgacttatggaacgtgcaatcaagctggagagcacagacgcgacaagagatcagtggcgttagctccccatgtcggcatgggactggacacacgcacccaaacctggatgtcggctgaaggagcctggaggcaagtcgagaaggtagagacatgggcccttaggcacccagggttcaccatactagccctatttcttgcccactacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagcccacgttggatatagagcttcaaaagaccgaggccacccaactggcgaccctgaggaagctatgcattgaggggaaaattaccaacataacaactgactcaagatgccccacccaaggggaagcggttttgcctgaggagcaggaccagaactacgtgtgtaagcatacatacgtggacagaggctgggggaacggatgtggtttgtttggcaagggaagcttggtaacatgtgcgaaatttcaatgcctggaaccaatagagggaaaaatggtgcaatatgagaacctcaaatacaccgtcatcatcacagtgcacacaggagaccaacaccaggtgggaaatgaaacgcagggagtcacagctgagataacacctcaggcatcaatcactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaaccatttttgcggggcacttaaaatgtagacttaaaatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcaggctgattacagccaacccagtggtgacaaaaaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaagtattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggtaaagaactcaaatgtggaagtggaatcttcgtcaccaacgaggtccatacctggacagagcaatacaaattccaagcagactccccaaaaagactggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagttaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagccgtcaaggatgagagggccgtacacgccgacatgggctattggatagaaagccaaaagaatggaagttggaaactagaaaaagcatccctcatagaggtgaaaacctgcacatggccaaaatcacataccctttggagtaatggtgtgctagagagtgacatgatcatcccaaggagcctagctggtcccatttcgcaacacaactacaggcccgggtaccacacccagacggcgggaccctggcatttaggaaaattagagctggatttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgttggtatggcatggaaatcagacccatcagtgagaaagaagagaacatggtaaagtctttggtctcagcggggagtggaaaggtggataacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagccttaattgcaacatttaaaatccagccattcttggctttgggatttttcctaagaaaactgacatccagagaaaatttattgttaggagttgggctggctatggcaacaacgttacaactgccagcggacattgaacaaatggcaaatggaatcgctctggggcttatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagtatgaggaaaacagactggcttccaatgacagtggcagctatgggagttcaacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggccgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcgcaatggcaaaagggggaggaggtgcaggtcattgccgtagagcctgggaagaacccaaagaactttcaaaccatgccaggcacttttcagactacaacaggggaaataggagcaattgcgctggatttcaagcctgggacttcaggatctcctatcataaacagagagggaaaggtagtgggactgtatggcaatggagtggtcacaaagaatggtggctacgtcagcggaatagcgcaaacgaatgcagaaccagatggaccgacaccagaattggaagaagagatgttcaaaaagcgaaatctaaccataatggatctccatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcaactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcataaaagccggaaatgacatagcaaactgcttgcgaaaaaacggaaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtctaggaagactttcgtggaactcatgaggaggggcgaccttccagtctggttagcccataaagtagcatcagaagggatcaaatatacagatagaaaatggtgctttgatggacaacgaaataatcaaatcttagaggagaacatggatgtggaaatttggacaaaagaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggattgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagaaagatttaggaatgtctaaggagccaggtgttgtttcttcaaccagctatttagatgtggacttgcacccagcatcagcctggacattgtacgccgtggccactacagtaataacaccaatgttaagacataccatagagaattctacagcaaatgtgtccctggcagccatagccaaccaggcagtggtcctgatgggtttggacaaaggatggccaatatcaaaaatggacttaggagtacccctactggcattgggttgctactcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgccttttctattatgaaatcagttggaacaggaaaaagaggaacaggctcacaaggtgaaactttaggagaaaaatggaaaaagaagttaaatcaattatcccggaaagagtttgacctttacaagaaatctggaattaccgaggtggatagaacggaagccaaagaagggttaaaaagaggagaaataacacatcatgccgtgtccagaggtagcgcaaaactccaatggttcgtggagagaaacatggtcattcccgaaggaagagtcatagacttgggctgtggaagaggaggttggtcatattactgtgcaggattgaaaaaagtcacagaagtgcgaggatacacaaaaggcggtccaggacacgaagaaccagtacctatgtccacatatggatggaacatagttaagttaatgactggaaaggatgtgttttatcttccacctgaaaagtgtgataccctgctgtgtgacattggagaatcttcaccaagcccaacagtggaagaaagcagaactataagagttttgaagatggttgaaccatggctaaagaacaaccagttttgtatcaaagtattgaacccttacatgccaactgtgattgagcatctagaaagattacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagagagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaaaggttatggggatcacagcggagtggctctggagaaccctgggaaggaacaaaaaacccaggctatgcacaagggaggagtttacaaaaaaggtcagaactaacgcagccatgggcgccgttttcacagaggagaaccaatgggacagcgcgaaagctgctgttgaggatgaggaattttggaaacttgtggacagagaacgtgaactccacaagttgggcaagtgtggaagctgtgtttacaacatgatgggcaagagagagaagaaacttggagagtttggcaaagcgaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccacgatacccggaggagcaatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggaacagtaatggacatcatatctaggaaagaccaaagaggcagtgggcaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaattgatgataggttcgctaatgccctgctcgctctgaacgatatgggaaaggtccggaaagatatacctcaatggcagccatcaaagggatggcatgattggcaacaggttcctttctgctcccaccactttcatgaattgatcatgaaagatggaagaaagttggtggttccctgcagaccccaggacgaattaataggaagagcaagaatctctcaaggagcgggatggagccttagagaaaccgcatgtttggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagaaaacatgcttactgtctggaacagggtgtggatcgaggacaatccatggatggaagacaaaaccccagttacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagaggtttaggaaagaggaggagtcggagggagccatttggtaa

SEQ ID NO: 7358 - RNA, 9873 nt, synthetic construct
  misc_feature 1..9873: note = derived and/or modified CDS sequence (wt) from DENV-3__FJ882575__SS-prME
  source 1..9873: mol_type = other RNA
acatcgctctgtctcatgatgatattgccagcaacacttgctttccacttgacttcacgagatggagagccgcgcatgattgtggggaagaatgaaagaggaaaatccctactttttaagacagcctctggaattaacatgtgcacactcatagctatggacttgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggttgtggtttgtttggcaagggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttagatttcaatgaaatgatcttactaacaatgaagaacaaagcatggatggtacatagacaatggttttttgacctacctctaccatggacatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgatcacagccaacccagtggtgactaagaaggaggagcctgtcaatattgaggctgaacctccttttggggaaagtaatatagtaattggaattggagacaacgctttgaaaatcaactggtacaagaaaggaagctctattgggaagatgttcgaggccactgccagaggtgcaaggcgcatggccatcttgggagacacagcttgggactttggatcagtgggtggtattctgaactcattaggcaaaatggtgcaccaaatattcggaagtgcttacacagccctattcagtggagtctcttgggtgatgaaaattggaataggtgttctcttgacttggatagggttgaattcaaaaaacacatccatgtcattttcatgcattgcgataggaatcattacactctatctgggagctgtggtacaagctgacatggggtgtgtcataaactggaaaggcaaagaactcaaatgtggaagtggaattttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcttgtggaagcaaatagccaatgaactgaactacatattatgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacacactctttggagtaatggcgtgctagagagtgacatgatcatcccaaagagtctagctggtcctatttcgcaacacaactacaggcccgggtaccacacccaaacggcaggaccctggcacttaggaaaattggagctggacttcaactattgtgaaggaacaacagttgtcatcacagaaaactgtgggacaagaggcccatcattgagaacaacaacagtgtcagggaagttgatacacgaatggtgttgccgctcgtgcacacttcctcccctgcgatacatgggagaagacggctgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcaggggttttcttcacgtttgtgctccttctctcagggcaaataacatggagagacatggcgcacacactaataatgattgggtccaacgcctctgacaggatgggaatgggcgtcacctacctagctttaattgcaacatttaaaatccagccattcttggctttgggatttttcctaagaaaactgacatctagagaaaatttattgttaggagttgggctggctatggcaacaacgttacaactgccagaggacattgaacaaatggcaaatggaatcgctctggggctcatggctcttaaactgataacacaatttgaaacataccaattatggacggcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacccctaccactttttatttttagcttgaaagacacactcaaaaggagaagctggccactgaatgaaggggtgatggctgttgggcttgtgagcattctggccagttctctccttagaaatgatgtgcccatggctggaccattagtggccgggggcttgctgatagcgtgctacgtcataactggcacgtcagcagacctcactgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggcatctttccatactccatacccgcaacattgttggtctggcatacttggcaaaagcaaacccaaagatccggcgttctatgggacgtacccagccccccagagacacagaaagcagaactggaagaaggggtctacaggatcaaacagcaaggaattcttgggaaaacccaagtaggggttggagtacagaaagaaggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagaggggaaggtagtgggactgtatggcaatggagtggttacaaagaatggtggctacgttagcggaatagcgcaaacaaatgcagaaccagatggaccgacaccagagttggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcttgctgtcaccagttagggttccaaattataacttgataataatggatgaggcccatttcacagacccagccagtatagcggctagagggtacatatcaactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggattaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaagactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggattataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaagggatcaaatatacagatagaaaatggtgctttgatggacaacgcaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccacagaacgagaaacgctctggacaatctggtgatgctgcatacgtcagaacatggcggtagggcctacaggcatgcggtggaggaactaccagaaacaatggaaacactcctactcttgggactcatgatcttgttgacaggtggagcaatgcttttcttgatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggactgttggaaactacaaagagagatttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactactggcattgggttgctattcacaagtgaacccactgactctaacagcggcagtacttttgctaatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttttatcttccacctgaaaagtgtgataccctgttgtgtgacattggagaatcttcaccaagcccaacagtggaagaaagcagaactataagagttttgaagatggttgaaccatggctaaaaaacaaccagttttgcattaaagtattgaacccttacatgccaactgtgattgagcacctagaaagactacaaaggaaacatggaggaatgcttgtgagaaatccactttcacgaaactccacgcacgaaatgtactggatatctaatggcacgggtaacattgtctcttcagtcaacatggtatctagattgctactgaacaggttcacgatgacacacaggagacccaccatagagaaagatgtggatttaggagcaggaactcgacatgttgatgcggaaccagaaacacccaacatggatgtcattggggaaagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggcccatgccagggacaagaaaggttatggggatcacagcggagtggctttggagaaccctgggaaggaacaaaagacccaggttatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggtaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacgggcacggtaatggacatcatatctaggaaagaccaaagaggcagtggacaggtgggaacttatggtctgaatacattcaccaacatggaagcccagttagtcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgcttgctctgaacgatatgggaaaggtccggaaagacatacctcaatggcaaccatcaaagggatggcatgattggcaacaggttcctttctgctcccaccactttcatgaattgatcatgaaagatggaagaaagttggtggttccctgcagaccccaagacgaactaataggaagagcaagaatctctcaaggagcgggatggagccttagagaaaccgcatgtctggggaaagcctacgctcaaatgtggagtctcatgtattttcacagaagagatctcagactagcatccaacgccatatgttcagcagtaccagtccactgggtccccacaagtagaacgacatggtctattcatgctcaccatcagtggatgactacagaagacatgcttactgtctggaacagggtgtggatcgaggacaatccatggatggaagacaaaactccagttacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagattcaggaaggaggaggagtcggagggagccatttggtaa

SEQ ID NO: 7359 - RNA, 9873 nt, synthetic construct
  misc_feature 1..9873: note = derived and/or modified CDS sequence (wt) from DENV-3__GQ199886__SS-prME
  source 1..9873: mol_type = other RNA
acatcgctctgtcttatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgaaaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccttaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcattatcacagtgcacacaggagaccaacaccaggtgggaaatgaaacgcagggagtcacggctgagataacacctcaggcatcaaccactgaagccatcttgccggaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaataccttcgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccctgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatatttggaagtgcttacacagccctattcagtggagtctcttgggtaatgaaaattggaataggagttctcttgacttggatggggttgaattcaaaaaacacatccatgtcattttcatgcatcgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagctattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggagtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtatcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttgattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcctgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacggttgatgatgatggaacaatgagaataaaagatgatgagactgagaatatcctaacagtgcttttgaaaacagcattactaatagtatcaggaatctttccatactccatacccgcaacattgttggtctggcacacttggcaaaagcaaacccaaagatccggcgttctatgggacgtacccagccctccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagctattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaactggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagccgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcaactcgtgttggaatgggagaggcagccgcaattttcatgacagcaacgccccctggaacagctgatgcctttcctcagagcaacgctccaattcaagatgaagaaaaggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaactcagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctagctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgttgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcctgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtaccactactagcactgggctgctattcacaagtgaacccactgactctcacagcggcagtactcttgctgattacacattatgctattataggtccaggattgcaggcaaaagccactcgtgaagctcagaaaaggacagctgctggaataatgaaaaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggtggtccaggacacgaagaaccagtacctatgtccacatatggatggaacatagttaaattaatgagtggaaaggatgtgttttatcttccacctgaaaagtgtgacaccctgttgtgtgacattggagaatcttcaccaagcccaacagtggaagaaagcagaaccataagagttttgaagatggttgaaccatggctaaagaacaaccaattttgcattaaagtattgaacccttacatgccaactgtgattgagcacctagaaagactacaaaggaaacatggaggtatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacctaggttatgcacaagggaagagtttacaaaaaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggcggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctaaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagttacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7360 - RNA, 9873 nt, synthetic construct
  misc_feature 1..9873: note = derived and/or modified CDS sequence (wt) from DENV-3__FJ882576__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaagtggttatttttatactactaatgctggtcactccatccatggcaatgagatgtgtgggagtaggaaacagagattttgtggaaggtctatcgggagctacgtgggttgacgtggtgctcgagcacggtgggtgtgtgactaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgatctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaacttccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggacgtacccagccctccagagacacagaaagcagaactggaagaaggggtctataggatcaaacagcaaggaatttttgggaaaacccaagtaggggttggagtacagaaagaaggagtcttccacaccatgtggcacgtcacaagaggggcagtgttggcatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagatccagccagtatagcggctagagggtacatatcaactcgtgtaggaatgggagaggcagctgcaatcttcatgacagcaacgccccctggaacagctgatgcctttcctcagagcaacgctccaattcaagatgaagaaagggacatcccggaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggatttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgacgaagaccatgctcactggacagaagcaaaaatgctgctggacaacatcaacacaccagaagggattataccagctctctttgaaccagaaagggagaagtcagccgccatagacggtgaataccgcctgaagggtgagtccaggaagaccttcgtggaactcatgaggaggggtgacctcccagtttggctagcccataaagtagcatcagaagggatcaaatatacagatagaaaatggtgctttgatggagaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaagatggacttaggagtacccctactggcattgggctgctattcacaagtgaacccactgactctcacagcggcagtactcttgctgatcacacattatgctattataggtccaggattgcaggcaaaagccactcgtgaagctcaaaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactctcacgaaactccacgcacgaaatgtactggatatccaatggtacaggcaacatcgtctcttcagtcaacatggtatccagattgctactgaacagatttacaatgacacacaggagacccaccattgagaaagatgtggatttgggagcaggaacccgacatgtcaatgcggaaccagaaacacccaatatggacgtcattggagaaagaataaaaaggatcaaggaggagcataattcaacatggcactatgatgatgaaaatccttacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagttacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7361 - RNA, 9873 nt, synthetic construct
  misc_feature 1..9873: note = derived and/or modified CDS sequence (wt) from DENV-3__FJ850052__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtgcatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagataaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggattataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7362 - RNA, 9873 nt, synthetic construct
  misc_feature 1..9873: note = derived and/or modified CDS sequence (wt) from DENV-3__FJ873812__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatatccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctcgagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcctcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacgtgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaatccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatctccatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgcttcgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaagatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaagaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcaactagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcccttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatacctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7363 - RNA, 9873 nt, synthetic construct
  misc_feature 1..9873: note = derived and/or modified CDS sequence (wt) from DENV-3__FJ873813__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaacatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccaaacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgcttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctagctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagatatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcacgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7364 - RNA, 9873 nt, synthetic construct
  misc_feature 1..9873: note = derived and/or modified CDS sequence (wt) from DENV-3__FJ850048__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcaaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaagatggacaagggaaagctcacaatggcagactgattacagccaacccagtggtgactaagaaggaggagcctgtcaatattgaggctgaacctccttttggagaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaatttcaagcagactccccaaaaagattggcgacagccattgcaggcgcttgggagaatggagtgtgcggaattaggtcaacaaccagaatggagaatctcctgtggaagcaaatagccaatgaactgaactacatattatgggaaaacaatatcaaactaacggtagttgtgggtgatataattggcgtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacctagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtgataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttatgtgacattggagaatcttcaccaagcccaacagtggaagaaagcagaactataagagttttgaagatggttgaaccatggctaaagaacaaccaattttgcattaaagtattgaacccctacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagccggctgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgactacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacttgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7365 - RNA, 9873 nt, synthetic construct
  misc_feature 1..9873: note = derived and/or modified CDS sequence (wt) from DENV-3__FJ850049__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaacatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactaacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccaatgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcaaatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggattacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7366 - RNA, 9873 nt, synthetic construct
  misc_feature 1..9873: note = derived and/or modified CDS sequence (wt) from DENV-3__FJ898476__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtactgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7367 - RNA, 9873 nt, synthetic construct
  misc_feature 1..9873: note = derived and/or modified CDS sequence (wt) from DENV-3__FJ898475__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctcgagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcctcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacgtgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatctccatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaagatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcaactagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcccttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7368 - RNA, 9873 nt, synthetic construct
  misc_feature 1..9873: note = derived and/or modified CDS sequence (wt) from DENV-3__GQ199861__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaacatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgctgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccaatgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctaacgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggattacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7369 - RNA, 9873 nt, synthetic construct
  misc_feature 1..9873: note = derived and/or modified CDS sequence (wt) from DENV-3__GQ199862__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaagatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaatttcaagcagactccccaaaaagattggcgacagccattgcaggcgcttgggagaatggagtgtgcggaattaggtcaacaaccagaatggagaatctcctgtggaagcaaatagccaatgaactgaactacatattatgggaaaacaatatcaaactaacggtagttgtgggtgatataattggcgtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacactcagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacctagccccccagagacacagaaagcagaactggaagaaggggtctataggatcaaacagcaaggaattcttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcgttgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagctgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccagtaacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccctacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcacgtgagaactcttacagtggagtggaaggagaaggactgcacaagctaggctatatattaagggacatttccaagatacccggaggagccatgtatgctgatgacacagccggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7370 - RNA, 9873 nt, synthetic construct
  misc_feature 1..9873: note = derived and/or modified CDS sequence (wt) from DENV-3__GQ199863__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagtcatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgatatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcatttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaagcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcaaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggctgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7371 - RNA, 9873 nt, synthetic construct
  misc_feature 1..9873: note = derived and/or modified CDS sequence (wt) from DENV-3__GQ199864__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactaaacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaacatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagagatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagaacaatacaaattccaagcagactccccaaaaagattggcaacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccaaacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaataggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgcttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcacgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7372 - RNA, 9873 nt, synthetic construct
  misc_feature 1..9873: note = derived and/or modified CDS sequence (wt) from DENV-3__GQ199865__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaagtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaacatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacgatttttacgttgactgttgcctggagaacagccaccctgattttggccggagtttcgcttttaccaatgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgttacgtcataactggcacgtcagcagacctcaccgtagaaaaagcagcagatataacatggggggaagaggctgagcaaacaggagtgtcccacatgttaatgatcacagttgaggatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgctaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttgtgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcatagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7373 - RNA, 9873 nt, synthetic construct
  misc_feature 1..9873: note = derived and/or modified CDS sequence (wt) from DENV-3__GQ199870__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggagttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggattataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtcctggatatccaatggcacaggtaacatcgtcgcttcagtcaatatggtatctagactgctactgaacaggtccacgatgacacacagaagacctaccattgagaaagatgtggatttaggagcaggacctcgacatgttaatgcggacccagaaccacccaatatggatgtcattggggaaagaataaaaagggtcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgccacagatggcaatgacagacacaactccatttggccagcagagagtctttaaagagaaagtggacaccaggacacccaggtccatcccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7374 - RNA, 9873 nt, synthetic construct
  misc_feature 1..9873: note = derived and/or modified CDS sequence (wt) from DENV-3__JF937630__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcactatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggcttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatgcctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacacaccctttggagtaatggtgtgctagagagtgacatgatcatcccaaagagtctagctggtcctatttcgcaacacaaccacaggcccgggtaccacactcagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcaaccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacctagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgatcttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtgttgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7375 - RNA, 9873 nt, synthetic construct
  misc_feature 1..9873: note = derived and/or modified CDS sequence (wt) from DENV-3__JN000936__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagttgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcagggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaagatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaatttcaggcagactccccaaaaagattggcgacagccattgcaggcgcttgggagaatggagtgtgcggaattaggtcaacaaccagaatggagaatctcctgtggaagcaaatagccaatgaactgaactacatattatgggaaaacaatatcaaactaacggtagttgtgggtgatataattggcgtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttgggaaaattagagctggacttcaactattgtgaaggaacaacggttgtcattacagaaaattgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttgtcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaatataccaattatggacagcattaatctccttaacgtgttcaaatacgatttttacgttgactgttgcctggagaacagccaccctgattttggccggagtttcgcttttaccaatgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccctccagagacacagaaggcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaacgactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaattggactcatttgtgtaattacttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccctacatgccaactgtgattgagcacctagaaagactacaaaggaaacatggaggaatgcttgtgagaaatccactttcacgaaactctacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggaaaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagccggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagatgacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacttgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7376 - RNA, 9873 nt, synthetic construct
  misc_feature 1..9873: note = derived and/or modified CDS sequence (wt) from DENV-3__HQ541796__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaatcaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacacagtgattggaattggagacaacgccttgaaaatcaactggtataagaagggaagctctattgggaagatgttcgaggccactgccagaggtgcaaggcgcatggccatcttgggagatacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcgttaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacattacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagccatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttacagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaaccaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7377 - RNA, 9873 nt, synthetic construct
  misc_feature 1..9873: note = derived and/or modified CDS sequence (wt) from DENV-3__HQ166034__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcttctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaagtagagacatgggcccttaggcacccagggttcaccatactagccctatttcttgcccattacataggcacatccttgacccagaaggtggttatttttatactactaatgctagtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaacatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagctacaacggaaacaccaacttggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaggctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaattgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaatataccaattatggacagcattaatctccttaacgtgttcaaatacgatttttacgttgactgttgcctggagaacagccaccctgattttggccggagtttcgcttttaccaatgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgtcctatgggacgtacccagccctccagagacacagaaggcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcccggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctagctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgttgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagtttttcatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtccaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccacccgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgtagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggcgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggagcagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactggcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7378 - RNA, 9873 nt, synthetic construct
  misc_feature 1..9873: note = derived and/or modified CDS sequence (wt) from DENV-3__HM756274__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcactatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggcttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatgcctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtgggggttggagtacagaaagaaggagttttccacaccatgtggcacgtcacaagaggggcagtgttgacacacaatgggaaaagactggaaccaaactgggctagcgtgaaaaaagatctgatttcatacggaggaggatggagattgagcgcacaatggcaaaagggggaggaggtgcaggttattgccgtagaacctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgatcttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtgttgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7379 - RNA, 9873 nt, synthetic construct
  misc_feature 1..9873: note = derived and/or modified CDS sequence (wt) from DENV-3__HM756275__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaagttgagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacgtgtgcgaaatttcaatgcctagaaccaatagagggaaaagtggtgcaacatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgttcaccacggacaggcttggatttcaatgaaatgatcttgctaacaatgaagaacaaagcatggatggtacatagacaatggttttttgacctacctctaccatggacatcaggagctacaacggaaacaccaacttggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaggctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaattgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaatataccaattatggacagcattaatctccttaacgtgttcaaatacgatttttacgttgactgttgcctggagaacagccaccctgattttggccggagtttcgcttttaccaatgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccctccagagacacagaaggcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcagctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctagctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggataatctggtgatgctgcatacatcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgtagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggcgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacccatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtaccagtccactgggtccccacaagtaggacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7380 - RNA, 9873 nt, synthetic construct
  misc_feature 1..9873: note = derived and/or modified CDS sequence (wt) from DENV-3__JF937632__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggccaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcatactgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggccgaacctccttttggggaaagcaacatagtgattggaattggagacaacgccttgaaaatcaactggtataagaagggaagctctattgggaagatgttcgaggccacagccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacataggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaagagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggacgaagcccatttcacagacccagccagtatagcggctagagggtacatatcgactcgtgttggaatgggagaggcagcggcaattttcatgacagcaacgccccctggaacagctgacgcctttcctcagagcaacgctccaattcaagatgaagaaagggacataccagaacgctcatggaattcaggcaatgaatggataaccgactttgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggcccacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaggctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggctattagcggggatgattgcgtagtgaaaccaatcgatgacaggttcgctaatgccctgctcgctctgaacgatatgggaaaggttcggaaagacatacctcaatggcagccatcaaagggatggcatgactggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgcctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7381 - RNA, 9873 nt, synthetic construct
  misc_feature 1..9873: note = derived and/or modified CDS sequence (wt) from DENV-3__HM756281__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaagatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttgtaaactggaaaggcaaagaactcaaatgtggaagtggaatcttcgtcaccaacgaggtccatacctggacagaacaatacaaatttcaagcagactccccaaaaagattggcgacagccattgcaggcgcttgggagaatggagtgtgcggaattaggtcaacaaccagaatggagaatctcctgtggaagcaaatagccaatgaactgaactacatattatgggaaaacaatatcaaactaacggtagttgtgggtgatataattggcgtcttagagcaaggaaaaagaacactaacaccacaacccaaggagctaaaatactcatggaaaacgtggggaaaggcaaagatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacacaccctttggagtaatggtgtgctagagagtgacatgatcatcccaaagagtctagctggtcctatttcgcaacacaaccacaggcccgggtaccacactcagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacctagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcgttgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaattgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagccgcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccctacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttagagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcacgtgagaactcttacagtggagtggaaggagaaggactgcacaagctaggctatatattaagggacatttccaagatacccggaggagccatgtatgctgatgacacagccggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7382 - RNA, 9873 nt, synthetic construct
  misc_feature 1..9873: note = derived and/or modified CDS sequence (wt) from DENV-3__JF937643__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagttgagaaggtagagacatgggcccttaggcacccagggtttaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccattttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcagggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaagatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaatttcaagcagactccccaaaaagattggcgacagccattgcaggcgcttgggagaatggagtgtgcggaattaggtcaacaaccagaatggagaatctcctgtggaagcaaatagccaatgaactgaactacatattatgggaaaacaatatcaaactaacggtagttgtgggtgatataattggcgtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagaaggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcaggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgatagcacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgttataactggcacgtcagcagacctcaccgtagaaaaagcagcagatataacatgggaggaagaggctgagcaaacaggagtgtcccacaacttaatgatcgcagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtgcctagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggccagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgccctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcagtaatagcagccaatgaaatgggattgctagaaactacaaagagagatttaggaatgtctaaggagccaggtgttgtctctccaaccagctatttagatgtggacttgcatccagcgtcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaatatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccctacatgccaactgtgattgagcacctagaaagactacaaaggaaacatggaggaatgcttgtgagaaatccactttcacgaaactctacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaacgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagccggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagatgacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacttgggcccagaacatacccacagcaattcaacaggtgagaagccttataggcaatgaagagtttctggactacatgccttcaatgaagagatttaggaaggaggaggagtcggagggagccatttggtaa
